United States Patent
Dower et al.

(10) Patent No.: US 11,248,030 B2
(45) Date of Patent: Feb. 15, 2022

(54) DUAL IL-2R AND IL-7R BINDING COMPOUNDS

(71) Applicant: MEDIKINE, INC., Menlo Park, CA (US)

(72) Inventors: William J. Dower, Menlo Park, CA (US); Michael C. Needels, Menlo Park, CA (US); Ronald W. Barrett, Menlo Park, CA (US); Alice V. Bakker, Menlo Park, CA (US); Steven E. Cwirla, Menlo Park, CA (US)

(73) Assignee: MEDIKINE, INC., Menlo Park, CA (US)

(*) Notice: Subject to any disclaimer, the term of this patent is extended or adjusted under 35 U.S.C. 154(b) by 0 days.

(21) Appl. No.: 17/089,533

(22) Filed: Nov. 4, 2020

(65) Prior Publication Data

US 2021/0130424 A1 May 6, 2021

Related U.S. Application Data

(60) Provisional application No. 63/071,946, filed on Aug. 28, 2020, provisional application No. 63/041,158, filed on Jun. 19, 2020, provisional application No. 62/969,432, filed on Feb. 3, 2020, provisional application No. 62/930,758, filed on Nov. 5, 2019.

(51) Int. Cl.
*A61K 38/00* (2006.01)
*C07K 14/47* (2006.01)
*C07K 7/08* (2006.01)

(52) U.S. Cl.
CPC ............. *C07K 14/47* (2013.01); *C07K 7/08* (2013.01); *A61K 38/00* (2013.01)

(58) Field of Classification Search
None
See application file for complete search history.

(56) References Cited

U.S. PATENT DOCUMENTS

| | | | |
|---|---|---|---|
| 5,635,597 | A | 6/1997 | Barrett et al. |
| 9,861,705 | B2 | 1/2018 | Bossard et al. |
| 10,689,417 | B2 | 6/2020 | Dower et al. |
| 10,703,776 | B2 | 7/2020 | Dower et al. |
| 2003/0166163 | A1 | 9/2003 | Gillies |
| 2011/0243887 | A1 | 10/2011 | Lauder et al. |
| 2013/0330296 | A1 | 12/2013 | Khaled |
| 2017/0327555 | A1 | 11/2017 | Greve |
| 2018/0125941 | A1 | 5/2018 | Greve |
| 2018/0162919 | A1 | 6/2018 | Greve et al. |
| 2018/0362655 | A1 | 12/2018 | Wang et al. |
| 2019/0119346 | A1 | 4/2019 | Garcia et al. |
| 2019/0153058 | A1 | 5/2019 | Greve |
| 2019/0194255 | A1 | 6/2019 | Tagaya et al. |
| 2019/0202881 | A1 | 7/2019 | Greve |
| 2019/0202882 | A1 | 7/2019 | Greve |
| 2020/0040034 | A1 | 2/2020 | Dower et al. |
| 2020/0291066 | A1 | 9/2020 | Dower et al. |
| 2020/0291067 | A1 | 9/2020 | Dower et al. |
| 2021/0198336 | A1 | 7/2021 | Dower et al. |
| 2021/0253669 | A1 | 8/2021 | Dower et al. |
| 2021/0253670 | A1 | 8/2021 | Dower et al. |

FOREIGN PATENT DOCUMENTS

| | | |
|---|---|---|
| WO | 2010/099084 | 9/2010 |
| WO | 2017/136818 | 8/2017 |

OTHER PUBLICATIONS

Partial International Search for PCT Application No. PCT/US2019/045109, dated Nov. 5, 2019, 17 pages.
International Search Report and Written Opinion for PCT Application No. PCT/US2019/045109, dated Jan. 14, 2020, 20 pages.
Klein et al., "Cergutuzumab amunaleukin (CEA-IL2v), a CEA-targeted IL-2 variant-based immunocytokine for combination cancer immunotherapy: Overcoming limitations of aldeslukin and conventional IL-2-based immunocytokines," OncoImmunology, 2017, vol. 6, No. 3, e1277306, 15 pages.
Levin et al., "Exploiting a natural conformational switch to engineer an interleukin-2 'superkine'," Nature, Apr. 2012, vol. 484, p. 529-533.
Mitra et al., "Interleukin-2 Activity can be Fine-Tuned with Engineered Receptor Signaling Clamps," Immunity, May 2015, vol. 42, No. 5, 29 pages.
Pulliam et al., "Common gamma chain cytokines in combinatorial immune strategies against cancer," Immunology Letters, 2016, vol. 169, p. 61-72.
International Search Report and Written Opinion for PCT Application No. PCT/US2020/058963, dated Apr. 7, 2021, 12 pages.
International Search Report and written Opinion for PCT Application No. PCT/US2020/058969, dated Apr. 6, 2021, 14 pages.
UNIPROTKB Accession No. A0A227JM75, Oct. 25, 2017, retrieved from https://www.uniprot.org/uniprot/A0A227JM75, entire document retrieved on Mar. 22, 2021, 5 pages.
UNIPROTKB Accession No. A0A2D7IYS8, Apr. 25, 2018, retrieved from https://www.uniprot.org/uniprot/A0A2D7IYS8, entire document retrieved on Mar. 19, 2021, 3 pages.
UNIPROTKB Accession No. A0A1D1ZF92, Nov. 30, 2016, retrieved from https://www.uniprot.org/uniprot/A0A1D1ZF92, entire document retrieved on Mar. 19, 2021, 3 pages.
International Search Report and Written Opinion for PCT Application No. PCT/US2021/016356, dated Jul. 13, 2021, 12 pages.
International Search Report and Written Opinion for PCT Application No. PCT/US2021/016361, dated Jul. 15, 2021, 12 pages.

(Continued)

*Primary Examiner* — Sergio Coffa

(57) ABSTRACT

Dual receptor binding compounds comprising IL-2Rβ, IL-7Rα, and Rγc ligands, and pharmaceutical compositions comprising the dual receptor binding compounds are disclosed. The dual receptor binding compounds can act as IL-2R and IL-7R agonists and are useful in treating cancer, viral diseases, autoimmune diseases, and inflammatory diseases.

20 Claims, 64 Drawing Sheets

Specification includes a Sequence Listing.

(56) References Cited

OTHER PUBLICATIONS

Betts et al., "Chapter 14: Amino Acid Properties and Consequences of Substitutions, Bioinformatics for Geneticists", 2003, Barnes and Gray Eds., 28 pages.
Chen et al., "Fusion Protein Linkers: Property, Design and Functionality", Advanced Drug Delivery Reviews, Oct. 2013, vol. 65, No. 10, pp. 1357-1369.
Dower et al., "MDK/MDK-701 : A potent fully efficacious peptidyl agonist of IL-7Rαγc, designed with no reference to cytokine or receptor structure and unrelated to IL-7, fused to an FC-domain for PK enhancement", Journal for ImmunoTherapy of Cancer, 2020, vol. 8, Issue 3, pp. A341-A342.
McElroy et al., "Structural reorganization of the interleukin-7 signaling complex", PNAS, 2012, vol. 109, No. 7, pp. 2503-2508.
Moors et al., "lnterneukin-7 (IL-7) and IL-7 splice variants affect differentiation of human neural progenitor cells", Genes and Immunity, 2010, vol. 11, pp. 11-20.
UNIPROTKB Accession No. A0A444GHQ1, May 8, 2019, retrieved from https://www.uniprot.org/uniprot/A0A444GHQ1, entire document retrieved on Jun. 12, 2021.
UNIPROTKB Accession No. A0A0N1IMW7, Dec. 9, 2015, retrieved from https://www.uniprot.org/uniprot/A0A0N1IMW7, entire document retrieved on Jun. 12, 2021.

| Ligand No. | Orientation P1/P2 | IL-2Rβ Ligand N-terminus | IL-2Rβ Ligand Amino Acid Sequence | IL-2Rβ Ligand C-terminus | Linker Structure | IL-2Rγc Ligand N-terminus | IL-2Rγc Ligand Amino Acid Sequence | IL-2Rγc Ligand C-terminus |
|---|---|---|---|---|---|---|---|---|
| (BGL1) | C/C | H₂N– | –GG–YDCRIAQVGELCDL–GG– SEQ ID NO: 558 | (AL1) | L2 | H₂N– | –DCSMWEGVELCW–GG– SEQ ID NO: 9624 | (AZ1) |
| (BGL2) | C/C | H₂N– | –GG–YDCRIAQVGELCDL–GG– SEQ ID NO: 558 | (AL1) | L2 | H₂N– | –GG–VVCQDWEGVELCWQ–GG– SEQ ID NO: 9340 | (AZ1) |
| (BGL3) | C/C | H₂N– | –GG–YDCRIAQVGELCDL–GG– SEQ ID NO: 558 | (AL2) | L3 | H₂N– | –GG–VVCQDWEGVELCWQ–GG– SEQ ID NO: 9340 | (AZ2) |
| (BGL4) | N/C | (AL3) | –GG–YDCRIAQVGELCDL–GG– SEQ ID NO: 558 | –C(O)–NH₂ | L4 | H₂N– | –DCSMWEGVELCW–GG– SEQ ID NO: 9624 | (AZ1) |
| (BGL5) | C/N | H₂N– | –GG–YDCRIAQVGELCDL–GG– SEQ ID NO: 558 | (AL1) | L5 | (AZ3) | –DCSMWEGVELCW–GG– SEQ ID NO: 9624 | –C(O)–NH₂ |
| (BGL6) | N/N | (AL3) | –GG–YDCRIAQVGELCDL–GG– SEQ ID NO: 558 | –C(O)–NH₂ | L6 | (AZ3) | –DCSMWEGVELCW–GG– SEQ ID NO: 9624 | –C(O)–NH₂ |
| (BGL7) | C/C | H₂N– | –G–VQYKKCWMAQLGDLCELDPS–GG– SEQ ID NO: 9622 | (AL5) | L7 | H₂N– | –DCSMWEGVELCW–GG– SEQ ID NO: 9624 | (AZ2) |
| (BGL8) | C/C | H₂N– | –GG–YPCWMAQLGELCDL–GG– SEQ ID NO: 9623 | (AL2) | L3 | H₂N– | –DCSMWEGVELCW–GG– SEQ ID NO: 9624 | (AZ2) |
| (BGL9) | C/C | H₂N– | –GG–WYPCWMAQLGELCDLD–GG– SEQ ID NO: 9301 | (AL2) | L3 | H₂N– | –DCSMWEGVELCW–GG SEQ ID NO: 9624 | (AZ2) |
| (BGL10) | C/C | H₂N– | –GG–WYPCWMAQLGELCDLD–GG– SEQ ID NO: 9301 | (AL2) | L3 | H₂N– | –DCSMWEGVELCW–GG– SEQ ID NO: 9624 | (AZ2) |
| (BGL11) | C/C | H₂N– | –GG–WYPCWMAQLGELCDLD–GG– SEQ ID NO: 9301 | (AL2) | L3 | H₂N– | –GG–VVCQDWEGVELCWQ–GG– SEQ ID NO: 9340 | (AZ2) |
| (BGL12) | C/C | H₂N– | –GG–YPCHMAQLGELCDLWSWGD–GG– SEQ ID NO: 561 | (AL2) | L3 | H₂N– | –DCSMWEGVELCW–GG– SEQ ID NO: 9624 | (AZ2) |
| (BGL13) | C/C | H₂N– | –GG–WYPCWMAQLGELCDLD–GG– SEQ ID NO: 9301 | (AL2) | L3 | H₂N– | –GG–VMCERWQGVELCWL–GG– SEQ ID NO: 1602 | (AZ2) |

FIG. 19A

| Ligand No. | Orientation P1/P2 | IL-2Rβ Ligand N-terminus | IL-2Rβ Ligand Amino Acid Sequence | IL-2Rβ Ligand C-terminus | Linker Structure | IL-2Rγc Ligand N-terminus | IL-2Rγc Ligand Amino Acid Sequence | IL-2Rγc Ligand C-terminus |
|---|---|---|---|---|---|---|---|---|
| (BGL14) | N/N | (AL4) | —GG—WYPCWMAQLGELCDLD—GG— SEQ ID NO: 9301 | —C(O)—NH₂ | L8 | (AZ4) | —GG—VVCQDWEGVELCWQ—GG— SEQ ID NO: 9340 | —C(O)—NH₂ |
| (BGL15) | N/C | (AL4) | —GG—WYPCWMAQLGELCDLD—GG SEQ ID NO: 9301 | —C(O)—NH₂ | L9 | H₃C-C(O)— | —GG—VVCQDWEGVELCWQ—GG SEQ ID NO: 9340 | (AZ5) |
| (BGL16) | N/C | H₃C-C(O)— | —GG—WYPCWMAQLGELCDLD—GG— SEQ ID NO: 9301 | (AL2) | L10 | H₃C-C(O)— | —GG—VVCQDWEGVELCWQ—GG— SEQ ID NO: 9340 | (AZ5) |
| (BGL17) | C/N | H₃C-C(O)— | —GG—WYPCWMAQLGELCDLD—GG— SEQ ID NO: 9301 | (AL2) | L11 | (AZ4) | —GG—VVCQDWEGVELCWQ—GG— SEQ ID NO: 9340 | —COOH |
| (BGL18) | C/N | H₃C-C(O)— | —GG—WYPCWMAQLGELCDLD— SEQ ID NO: 9308 | (AL6) | L12 | (AZ4) | —GG—VVCQDWEGVELCWQ—GG SEQ ID NO: 9340 | —COOH |
| (BGL19) | C/N | H₃C-C(O)— | —GG—WYPCWMAQLGELCDLD— SEQ ID NO: 9308 | (AL7) | L13 | (AZ4) | —GG—VVCQDWEGVELCWQ—GG— SEQ ID NO: 9340 | —COOH |
| (BGL20) | C/N | H₃C-C(O)— | —GG—WYPCWMAQLGELCDLD—GG— SEQ ID NO: 9301 | (AL2) | L11 | (AZ4) | —GG—VVCQDWEGVELCWQ—GG— SEQ ID NO: 9340 | —COOH |
| (BGL21) | C/N | H₃C-C(O)— | —GG—WYPCWMAQLGELCDLD—GG— SEQ ID NO: 9301 | — | L1 | — | —GG—VVCQDWEGVELCWQ—GG— SEQ ID NO: 9340 | —COOH |
| (BGL22) | C/N | H₃C-C(O)— | —GG—WYPCWMAQLGELCDLD—GG— SEQ ID NO: 9301 | (AL2) | L11 | (AZ4) | —GG—RTGVECQDWHGVELCWPWE—GG— SEQ ID NO: 1606 | —COOH |
| (BGL23) | C/N | H₃C-C(O)— | —GG—WYPCWMAQLGELCDLD—GG— SEQ ID NO: 9301 | (AL2) | L11 | (AZ4) | —GG—VGIECEEWAGVELCWL—GG SEQ ID NO: 1603 | —COOH |
| (BGL24) | C/N | H₃C-C(O)— | —GG—WYPCWMAQLGELCDLD—GG— SEQ ID NO: 9301 | (AL2) | L11 | (AZ4) | —GG—TWNMSELECQDWNGVEICWH—GG— SEQ ID NO: 1604 | —COOH |
| (BGL25) | C/N | H₃C-C(O)— | —GG—WYPCWMAQLGELCDLD—GG— SEQ ID NO: 9301 | (AL2) | L11 | (AZ4) | —GG—RTEVECEDWEGVELCWL—GG— SEQ ID NO: 1605 | —COOH |
| (BGL26) | C/N | H₃C-C(O)— | —FYPCWTALLGELCDLEPGPPAM—GG— SEQ ID NO: 569 | (AL2) | L11 | (AZ4) | —GG—VVCQDWEGVELCWQ—GG— SEQ ID NO: 9340 | —COOH |

FIG. 19B

| Ligand No. | Orient-ation P1/P2 | IL-2Rβ Ligand | | | Linker Struct-ure | IL-2Rγc Ligand | | |
|---|---|---|---|---|---|---|---|---|
| | | N-terminus | Amino Acid Sequence | C-terminus | | N-terminus | Amino Acid Sequence | C-terminus |
| (BGL27) | C/N | H₃C—C(O)— | —WRRWYPCWVAQVGELCDLEIEA—GG— SEQ ID NO: 570 | (AL2) | L11 | (AZ4) | —GG—VVCQDWEGVELCWQ—GG— SEQ ID NO: 9340 | —COOH |
| (BGL28) | C/N | H₃C—C(O)— | —RQRWYPCWMARLGELCDLDEPT—GG— SEQ ID NO: 571 | (AL2) | L11 | (AZ4) | —GG—VVCQDWEGVELCWQ—GG— SEQ ID NO: 9340 | —COOH |
| (BGL29) | C/N | H₃C—C(O)— | —WYPCWMAQLGDLCDLEKPVTER—GG— SEQ ID NO: 572 | (AL2) | L11 | (AZ4) | —GG—VVCQDWEGVELCWQ—GG— SEQ ID NO: 9340 | —COOH |
| (BGL30) | C/N | H₃C—C(O)— | —GG—WYPCWIAQLGELCDLD—GG— SEQ ID NO: 9301 | (AL2) | L11 | (AZ4) | —GG—VVCQDWEGVELCWQ—GG— SEQ ID NO: 9340 | —COOH |

FIG. 19C (FP1) SEQ ID NO: 8012  hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWMAQLG
ELCDLDGGGGSGGGGVVCQDWEGVELCWQGG (FP2) SEQ ID NO: 8013  hIgG1v-Fc IL-2Rβγc ligand fusion protein
AEPKSSDKTHTCPPCPAPEAAGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALGAPIEKTISKAKGQ
PREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGARTGGGGSGGGGSGGWYPCWMA
QLGELCDLDGGGGSGGGGVVCQDWEGVELCWQGG (FP3) (SEQ ID NO: 8014  hIgG4-Fc IL-2Rβγc ligand fusion protein
APPCPPCPAPEFEGGPSVFLFPPKPKDTLMISRTPEVTCVVVDVSQEDPEVQFNWYVDGVEVHNA
KTKPREEQFNSTYRVVSVLTVLHQDWLNGKEYKCKVSNKGLGSSIEKTISKAKGQPREPQVYTL
PPSQEEMTKNQVSLTCLVKGFYPSDIAVEWESNGQPENNYKTTPPVLDSDGSFFLYSRLTVDKSR
WQEGNVFSCSVMHEALHNHYTQKSLSLSLGARTGGGGSGGGGSGGWYPCWMAQLGELCDLD
GGGGSGGGGVVCQDWEGVELCWQGG (FP4)  SEQ ID NO: 8015  hIgG1-Fc (N-terminal fusion) IL-2Rβγc ligand fusion protein
GGWYPCWMAQLGELCDLDGGGGSGGGVVCQDWEGVELCWQGGGGSGGGGSGGGGSRSDKTH
TCPPCPAPELLGGPSVFLFPPKPKDTLMISRTPEVTCVVVDVSHEDPEVKFNWYVDGVEVHNAKT
KPREEQYNSTYRVVSVLTVLHQDWLNGKEYKCKVSNKALPAPIEKTISKAKGQPREPQVYTLPP
SREEMTKNQVSLTCLVKGFYPSDIAVEWESNGQPENNYKTTPPVLDSDGSFFLYSKLTVDKSRW
QQGNVFSCSVMHEALHNHYTQKSLSLSPGK (FP5)  SEQ ID NO:  8016  hIgG1-Fc-Knob IL-2Rβγc ligand fusion protein
GITVAEPKSCDKTHTCPPCPAPEAAGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALPAPIEKTISKA

FIG. 20A

KGQPREPQVYTLPPSREEMTKNQVSLWCLVKGFYPSDIAVEWESNGQPENNYKTTPPVLDSDGS
FFLYSKLTVDKSRWQQGNVFSCSVMHEALHNHYTQKSLSLSPGGGGSGGGGSGGGGSGGGGGGWY
PCWMAQLGELCDLDGGGGSGGVVCQDWEGVELCWQGG (FP6) SEQ ID NO: 8017  hIgG1-Fc-Hole
EPKSCDKTHTCPPCPAPEAAGGPSVFLFPPKPKDTLMISRTPEVTCVVVDVSHEDPEVKFNWYVD
GVEVHNAKTKPREEQYNSTYRVVSVLTVLHQDWLNGKEYKCKVSNKALPAPIEKTISKAKGQP
REPQVYTLPPSREEMTKNQVSLSCAVKGFYPSDIAVEWESNGQPENNYKTTPPVLDSDGSFFLVS
KLTVDKSRWQQGNVFSCSVMHEALHNHYTQKSLSLSPG (FP7) SEQ ID NO: 8018  Pembrolizumab-LC
EIVLTQSPATLSLSPGERATLSCRASKGVSTSGYSYLHWYQQKPGQAPRLLIYLASYLESGVPARF
SGSGSGTDFTLTISSLEPEDFAVYYCQHSRDLPLTFGGGTKVEIKRTVAAPSVFIFPPSDEQLKSGT
ASVVCLLNNFYPREAKVQWKVDNALQSGNSQESVTEQDSKDSTYSLSSTLTLSKADYEKHKVY
ACEVTHQGLSSPVTKSFNRGEC (FP8) SEQ ID NO: 8019  Pembrolizumab-HC IL-2Rβγc ligand fusion protein
QVQLVQSGVEVKKPGASVKVSCKASGYTFTNYYMYWVRQAPGQGLEWMGGINPSNGGTNFNE
KFKNRVTLTTDSSTTTAYMELKSLQFDDTAVYYCARRDYRFDMGFDYWGQGTTVTVSSASTKG
PSVFPLAPCSRSTSESTAALGCLVKDYFPEPVTVSWNSGALTSGVHTFPAVLQSSGLYSLSSVVTV
PSSSLGTKTYTCNVDHKPSNTKVDKRVESKYGPPCPPCPAPEFLGGPSVFLFPPKPKDTLMISRTP
EVTCVVVDVSQEDPEVQFNWYVDGVEVHNAKTKPREEQFNSTYRVVSVLTVLHQDWLNGKEY
KCKVSNKGLPSSIEKTISKAKGQPREPQVYTLPPSQEEMTKNQVSLTCLVKGFYPSDIAVEWESN
GQPENNYKTTPPVLDSDGSFFLYSRLTVDKSRWQEGNVFSCSVMHEALHNHYTQKSLSLSLGAG
GGGSGGGGSGGWYPCWMAQLGELCDLDGGGGSGGVVCQDWEGVELCWQGG (FP9) SEQ ID NO: 8020  Cemiplimab-LC
DIQMTQSPSSLSASVGDSITITCRASLSINTFLNWYQQKPGKAPNLLIYAASSLHGGVPSRFSGSGS
GTDFTLTIRTLQPEDFATYYCQQSSNTPFTFGPGTVVDFRRTVAAPSVFIFPPSDEQLKSGTASVVC
LLNNFYPREAKVQWKVDNALQSGNSQESVTEQDSKDSTYSLSSTLTLSKADYEKHKVYACEVT
HQGLSSPVTKSFNRGEC

FIG. 20B (FP10) SEQ ID NO: 8021   Cemiplimab-HC  IL-2Rβγc ligand fusion protein
EVQLLESGGVLVQPGGSLRLSCAASGFTFSNFGMTWVRQAPGKGLEWVSGISGGGRDTYFADS
VKGRFTISRDNSKNTLYLQMNSLKGEDTAVYYCVKWGNIYFDYWGQGTLVTVSSASTKGPSVF
PLAPCSRSTSESTAALGCLVKDYFPEPVTVSWNSGALTSGVHTFPAVLQSSGLYSLSSVVTVPSSS
LGTKTYTCNVDHKPSNTKVDKRVESKYGPPCPPCPAPEFLGGPSVFLFPPKPKDTLMISRTPEVTC
VVVDVSQEDPEVQFNWYVDGVEVHNAKTKPREEQFNSTYRVVSVLTVLHQDWLNGKEYKCK
VSNKGLPSSIEKTISKAKGQPREPQVYTLPPSQEEMTKNQVSLTCLVKGFYPSDIAVEWESNGQPE
NNYKTTPPVLDSDGSFFLYSRLTVDKSRWQEGNVFSCSVMHEALHNHYTQKSLSLSLGAGGGGS
GGGGSGGWYPCWMAQLGELCDLDGGGGSGGVVCQDWEGVELCWQGG (FP11) SEQ ID NO: 8022  Daclizumab-LC
DIQMTQSPSTLSASVGDRVTITCSASSSISYMHWYQQKPGKAPKLLIYTTSNLASGVPARFSGSGS
GTEFTLTISSLQPDDFATYYCHQRSTYPLTFGQGTKVEVKRTVAAPSVFIFPPSDEQLKSGTASVV
CLLNNFYPREAKVQWKVDNALQSGNSQESVTEQDSKDSTYSLSSTLTLSKADYEKHKVYACEV
THQGLSSPVTKSFNRGEC (FP12) SEQ ID NO: 8023  Daclizumab-HC  IL-2Rβγc ligand fusion protein
QVQLVQSGAEVKKPGSSVKVSCKASGYTFTSYRMHWVRQAPGQGLEWIGYINPSTGYTEYNQK
FKDKATITADESTNTAYMELSSLRSEDTAVYYCARGGGVFDYWGQGTLVTVSSASTKGPSVFPL
APSSKSTSGGTAALGCLVKDYFPEPVTVSWNSGALTSGVHTFPAVLQSSGLYSLSSVVTVPSSSL
GTQTYICNVNHKPSNTKVDKKVEPKSCDKTHTCPPCPAPELLGGPSVFLFPPKPKDTLMISRTPEV
TCVVVDVSHEDPEVKFNWYVDGVEVHNAKTKPREEQYNSTYRVVSVLTVLHQDWLNGKEYK
CKVSNKALPAPIEKTISKAKGQPREPQVYTLPPSRDELTKNQVSLTCLVKGFYPSDIAVEWESNG
QPENNYKTTPPVLDSDGSFFLYSKLTVDKSRWQQGNVFSCSVMHEALHNHYTQKSLSLSPGAGG
GGSGGGGSGGWYPCWMAQLGELCDLDGGGGSGGVVCQDWEGVELCWQGG (FP13) SEQ ID NO: 8024  hIgG1-Fc (GS)$_{10}$ (N297A mutant)  IL-2Rβγc ligand fusion protein
DKTHTCPPCPAPELLGGPSVFLFPPKPKDTLMISRTPEVTCVVVDVSHEDPEVKFNWYVDGVEVH
NAKTKPREEQYASTYRVVSVLTVLHQDWLNGKEYKCKVSNKALPAPIEKTISKAKGQPREPQVY
TLPPSRDELTKNQVSLTCLVKGFYPSDIAVEWESNGQPENNYKTTPPVLDSDGSFFLYSKLTVDK
SRWQQGNVFSCSVMHEALHNHYTQKSLSLSPGAGSGSGSGSGSGSGSGSGSGSGGWYPCWMA

FIG. 20C

QLGELCDLDGGGGSGGVVCQDWEGVELCWQGG (FP14) SEQ ID NO: 8025  hIgG2-Fc (GS)10 IL-2Rβγc ligand fusion protein
ERKSSVECPPPCPAPPVAGPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTKGQPREPQV
YTLPPSREEMTKNQVSLTCLVKGFYPSDISVEWESNGQPENNYKTTPPMLDSDGSFFLYSKLTVD
KSRWQQGNVFSCSVMHEALHNHYTQKSLSLSPGAGSGSGSGSGSGSGSGSGSGGWYPCWM
AQLGELCDLDGGGGSGGVVCQDWEGVELCWQGG (FP15) SEQ ID NO: 8026  hIgG2-Fc (PA)10 IL-2Rβγc ligand fusion protein
ERKSSVECPPPCPAPPVAGPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTKGQPREPQV
YTLPPSREEMTKNQVSLTCLVKGFYPSDISVEWESNGQPENNYKTTPPMLDSDGSFFLYSKLTVD
KSRWQQGNVFSCSVMHEALHNHYTQKSLSLSPGAPAPAPAPAPAPAPAPAPAPAGGWYPCWM
AQLGELCDLDGGGGSGGVVCQDWEGVELCWQGG (FP16) SEQ ID NO: 8027  hIgG2-Fc (G4S)1 IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGWYPCWMAQLGELCDL
DGGGGSGGVVCQDWEGVELCWQGG (FP17) SEQ ID NO: 8028  hIgG2-Fc (G4S)3 IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGSGGWYPCW
MAQLGELCDLDGGGGSGGVVCQDWEGVELCWQGG (FP18) SEQ ID NO: 8029  hIgG2-Fc (G4S)4 IL-2Rβγc ligand fusion protein

FIG. 20D

APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGWYCQDWEGVELCWQGG (FP19) SEQ ID NO: 8030   hIgG2-Fc  (G)$_2$  IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGWYPCWMAQLGELCDLDGG
GGSGGVVCQDWEGVELCWQGG (FP20) SEQ ID NO: 8031   hIgG2-Fc  (G)$_5$  IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGGWYPCWMAQLGELCDL
DGGGGSGGVVCQDWEGVELCWQGG (FP21) SEQ ID NO: 8032   hIgG2-Fc  (GS)$_{10}$  IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGSGSGSGSGSGSGSGGWY
PCWMAQLGELCDLDGGGGSGGVVCQDWEGVELCWQGG (FP22) SEQ ID NO: 8033   hIgG2-Fc  (PA)$_5$  IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKCKVSNKGLPAPIEKTISKTKGQPRE
PQVYTLPPSREEMTKNQVSLTCLVKGFYPSDIAVEWESNGQPENNYKTTPPMLDSDGSFFLYSKL

FIG. 20E

TVDKSRWQQGNVFSCSVMHEALHNHYTQKSLSLSPGARTPAPAPAPAGGWYPCWMAQLGE
LCDLDGGGGSGGVVCQDWEGVELCWQGG (FP23) SEQ ID NO: 8034 hIgG2-Fc (PA)$_{10}$ IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTPAPAPAPAPAPAPAPAGGWY
PCWMAQLGELCDLDGGGGSGGVVCQDWEGVELCWQGG (FP24) SEQ ID NO: 8035 hIgG2-Fc (PA)$_7$ IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTPAPAPAPAPAPAGGWYPCWMA
QLGELCDLDGGGGSGGVVCQDWEGVELCWQGG (FP25) SEQ ID NO: 8036 hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGVQYKKCWMAQ
LGDLCELDPSGGGGSGGVVCQDWEGVELCWQGG (FP26) SEQ ID NO: 8037 hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGYPCHMAQLGEL
CDLWSWGDIGGGGSGGVVCQDWEGVELCWQGG

FIG. 20F (FP27) SEQ ID NO: 8038   hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGYPCWMAQLGEL
CDLGGGGSGGVVCQDWEGVELCWQGG (FP28) SEQ ID NO: 8039   hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWMAQLG
ELCDLDGGGGSGGGWSKKAEVVCEEWGGVEFCWIGG (FP29) SEQ ID NO: 8040   hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWMAQLG
ELCDLDGGGGSGGGRTGVECQDWHGVELCWPVWEGG (FP30) SEQ ID NO: 8041   hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWMAQLG
ELCDLDGGGGSGGGVGIECEEWAGVELCWLGG (FP31) SEQ ID NO: 8042   hIgG2-Fc IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE

FIG. 20G

PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLPGARTGGGGSGGGGSGGWYPCWMAQLG
ELCDLDGGGGSGGGTWNMSELECQDWNGVEICWHGG (FP32) SEQ ID NO: 8043   hIgG2-Fc   IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLPGARTGGGGSGGGGSGGWYPCWMAQLG
ELCDLDGGGGSGGGRTEVECEDWEGVELCWLGG (FP33) SEQ ID NO: 8044   hIgG2-Fc   IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLPGARTGGGGSGGGGSGGFYPCWTALLGE
LCDLEPGPPAMGGGGSGGVVCQDWEGVELCWQGG (FP34) SEQ ID NO: 8045   hIgG2-Fc   IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLPGARTGGGGSGGGGSGGWGTTWRWYPC
WMAQLGELCDLGGGGSGGVVCQDWEGVELCWQGG (FP35) SEQ ID NO: 8046   hIgG2-Fc   IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLPGARTGGGGSGGGGSGGDVLGDRWYPC
WIAKLGELCDLDGGGGSGGVVCQDWEGVELCWQGG

FIG. 20H (FP36) SEQ ID NO: 8047  hIgG2-Fc  IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWIAQLGE
LCDLDGGGGSGGGGGVVCQDWEGVELCWQGG (FP37) SEQ ID NO: 8048  hIgG2-Fc  IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWLAKLGE
LCDLDGGGGSGGGGGVVCQDWEGVELCWQGG (FP38) SEQ ID NO: 8049  hIgG2-Fc  IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWYPCWMAQLG
DLCDLEKPVTERGGGGSGGGVVCQDWEGVELCWQGG (FP39) SEQ ID NO: 8050  hIgG2-Fc  IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGWRRWYPCWVA
QVGELCDLEIEAGGGGSGGGGVVCQDWEGVELCWQGG (FP40) SEQ ID NO: 8051  hIgG2-Fc  IL-2Rβγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE

FIG. 20I

PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGRQRWYPCWMA
RLGELCDLDEPTGGGGSGGVVCQDWEGVELCWQGG (FP41) SEQ ID NO: 8052   HSA_IL-2Rβγc ligand fusion protein
GGHHHHHHGGDAHKSEVAHRFKDLGEENFKALVLIAFAQYLQQCPFEDHVKLVNEVTEFAKTC
VADESAENCDKSLHTLFGDKLCTVATLRETYGEMADCCAKQEPERNECFLQHKDDNPNLPRLV
RPEVDVMCTAFHDNEETFLKKYLYEIARRHPYFYAPELLFFAKRYKAAFTECCQAADKAACLLP
KLDELRDEGKASSAKQRLKCASLQKFGERAFKAWAVARLSQRFPKAEFAEVSKLVTDLTKVHT
ECCHGDLLECADDRADLAKYICENQDSISSKLKECCEKPLLEKSHCIAEVENDEMPADLPSLAAD
FVESKDVCKNYAEAKDVFLGMFLYEYARRHPDYSVVLLLRLAKTYETTLEKCCAAADPHECYA
KVFDEFKPLVEEPQNLIKQNCELFEQLGEYKFQNALLVRYTKKVPQVSTPTLVEVSRNLGKVGS
KCCKHPEAKRMPCAEDYLSVVLNQLCVLHEKTPVSDRVTKCCTESLVNRRPCFSALEVDETYVP
KEFNAETFTFHADICTLSEKERQIKKQTALVELVKHKPKATKEQLKAVMDDFAAFVEKCCKADD
KETCFAEEGKKLVAASQAALGLRTGGGGSGGGGSGGWYPCWMAQLGELCDLDGGGGSGGVV
CQDWEGVELCWQGG

FIG. 20J

| IL-2Rβγc Ligand Fusion Protein No. | SEQ ID NO: | Construct Partner | Construct linker | IL-2Rβ Ligand | | IL-2Rβγc Linker | IL-2Rγc Ligand | |
|---|---|---|---|---|---|---|---|---|
| | | | | Ligand No. | SEQ ID NO: | | Ligand No. | SEQ ID NO: |
| (FP1) | 8012 | hIgG2-Fc | (G4S)₂ | (BL4) | 9301 | (GGS)₁ | (GL2) | 9340 |
| (FP2) | 8013 | hIgG1v-Fc | (G4S)₂ | (BL4) | 9301 | (GGS)₁ | (GL2) | 9340 |
| (FP3) | 8014 | hIgG4-Fc | (G4S)₂ | (BL4) | 9301 | (GGS)₁ | (GL2) | 9340 |
| (FP4) | 8015 | hIgG1-Fc (N-terminal fusion) | (G4S)₃ | (BL4) | 9301 | (GGS)₁ | (GL2) | 9340 |
| (FP5) | 8016 | hIgG1-Fc-Knob | (G4S)₃ | (BL4) | 9301 | (GGS)₁ | (GL2) | 9340 |
| (FP6) | 8017 | hIgG1-Fc-Hole | - | - | - | - | - | - |
| (FP7) | 8018 | Pembrolizumab-LC | - | - | - | - | - | - |
| (FP8) | 8019 | Pembrolizumab-HC | (G4S)₂ | (BL4) | 9301 | (GGS)₁ | (GL2) | 9340 |
| (FP9) | 8020 | Cemiplimab-LC | - | - | - | - | - | - |
| (FP10) | 8021 | Cemiplimab-HC | (G4S)₂ | (BL4) | 9301 | (GGS)₁ | (GL2) | 9340 |
| (FP11) | 8022 | Daclizumab-LC | - | - | - | - | - | - |
| (FP12) | 8023 | Daclizumab-HC | (G4S)₂ | (BL4) | 9301 | (GGS)₁ | (GL2) | 9340 |
| (FP13) | 8024 | hIgG1-Fc | (GS)₁₀ | (BL4) | 9301 | (GGS)₁ | (GL2) | 9340 |
| (FP14) | 8025 | hIgG2-Fc | (GS)₁₀ | (BL4) | 9301 | (GGS)₁ | (GL2) | 9340 |
| (FP15) | 8026 | hIgG2-Fc | (PA)₁₀ | (BL4) | 9301 | (GGS)₁ | (GL2) | 9340 |
| (FP16) | 8027 | hIgG2-Fc | (G4S)₁ | (BL4) | 9301 | (GGS)₁ | (GL2) | 9340 |
| (FP17) | 8028 | hIgG2-Fc | (G4S)₃ | (BL4) | 9301 | (GGS)₁ | (GL2) | 9340 |

FIG. 21A

| IL-2Rβγc Ligand Fusion Protein No. | SEQ ID NO: | Construct Partner | Construct linker | IL-2Rβ Ligand | | IL-2Rβγc Linker | IL-2Rγc Ligand | |
|---|---|---|---|---|---|---|---|---|
| | | | | Ligand No. | SEQ ID NO: | | Ligand No. | SEQ ID NO: |
| (FP18) | 8029 | hIgG2-Fc | (G4S)₄ | (BL4) | 9301 | (GGS)₁ | (GL2) | 9340 |
| (FP19) | 8030 | hIgG2-Fc | (G)₂ | (BL4) | 9301 | (GGS)₁ | (GL2) | 9340 |
| (FP20) | 8031 | hIgG2-Fc | (G)₅ | (BL4) | 9301 | (GGS)₁ | (GL2) | 9340 |
| (FP21) | 8032 | hIgG2-Fc | (GS)₁₀ | (BL4) | 9301 | (GGS)₁ | (GL2) | 9340 |
| (FP22) | 8033 | hIgG2-Fc | (PA)₅ | (BL4) | 9301 | (GGS)₁ | (GL2) | 9340 |
| (FP23) | 8034 | hIgG2-Fc | (PA)₁₀ | (BL4) | 9301 | (GGS)₁ | (GL2) | 9340 |
| (FP24) | 8035 | hIgG2-Fc | (PA)₇ | (BL4) | 9301 | (GGS)₁ | (GL2) | 9340 |
| (FP25) | 8036 | hIgG2-Fc | (G4S)₂ | (BL1) | 559 | (GGS)₁ | (GL2) | 9340 |
| (FP26) | 8037 | hIgG2-Fc | (G4S)₂ | (BL2) | 561 | (GGS)₁ | (GL2) | 9340 |
| (FP27) | 8038 | hIgG2-Fc | (G4S)₂ | (BL3) | 9301 | (GGS)₁ | (GL2) | 9340 |
| (FP28) | 8039 | hIgG2-Fc | (G4S)₂ | (BL4) | 9301 | (GGS)₁ | (GL3) | 1607 |
| (FP29) | 8040 | hIgG2-Fc | (G4S)₂ | (BL4) | 9301 | (GGS)₁ | (GL4) | 1606 |
| (FP30) | 8041 | hIgG2-Fc | (G4S)₂ | (BL4) | 9301 | (GGS)₁ | (GL5) | 1603 |
| (FP31) | 8042 | hIgG2-Fc | (G4S)₂ | (BL4) | 9301 | (GGS)₁ | (GL6) | 1604 |
| (FP32) | 8043 | hIgG2-Fc | (G4S)₂ | (BL4) | 9301 | (GGS)₁ | (GL7) | 1605 |
| (FP33) | 8044 | hIgG2-Fc | (G4S)₂ | (BL6) | 562 | (GGS)₁ | (GL2) | 9340 |
| (FP34) | 8045 | hIgG2-Fc | (G4S)₂ | (BL5) | 560 | (GGS)₁ | (GL2) | 9340 |

FIG. 21B

| IL-2Rβγc Ligand Fusion Protein No. | SEQ ID NO: | Construct Partner | Construct linker | IL-2Rβ Ligand Ligand No. | IL-2Rβ Ligand SEQ ID NO: | IL-2Rβγc Linker | IL-2Rγc Ligand Ligand No. | IL-2Rγc Ligand SEQ ID NO: |
|---|---|---|---|---|---|---|---|---|
| (FP35) | 8046 | hIgG2-Fc | (G4S)$_2$ | (BL9) | 566 | (GGS)$_1$ | (GL2) | 9340 |
| (FP36) | 8047 | hIgG2-Fc | (G4S)$_2$ | (BL11) | 567 | (GGS)$_1$ | (GL2) | 9340 |
| (FP37) | 8048 | hIgG2-Fc | (G4S)$_2$ | (BL12) | 568 | (GGS)$_1$ | (GL2) | 9340 |
| (FP38) | 8049 | hIgG2-Fc | (G4S)$_2$ | (BL10) | 565 | (GGS)$_1$ | (GL2) | 9340 |
| (FP39) | 8050 | hIgG2-Fc | (G4S)$_2$ | (BL7) | 563 | (GGS)$_1$ | (GL2) | 9340 |
| (FP40) | 8051 | hIgG2-Fc | (G4S)$_2$ | (BL10) | 564 | (GGS)$_1$ | (GL2) | 9340 |
| (FP41) | 8052 | HSA | (G4S)$_2$ | (BL4) | 9301 | (GGS)$_1$ | (GL2) | 9340 |

FIG. 21C

| IL-7Rα/Rγc Ligand No. | Orientation P1/P2 | IL-7Rα Ligand ¹N-terminus | IL-7Rα Ligand Amino Acid Sequence | IL-7Rα Ligand ¹C-terminus | Linker Structure | Rγc Ligand ¹N-terminus | Rγc Ligand Amino Acid Sequence | Rγc Ligand ¹C-terminus |
|---|---|---|---|---|---|---|---|---|
| A | C-N | acetyl | Ac-VHRIPWCTLDPGGLQCAWLRQMGG- SEQ ID NO: 9320 | N/A | -GGS- | N/A | -GGVVCQDWEGVELCWQGG SEQ ID NO: 9340 | -COOH |
| B | C-N | H₂N- | VHRIPWCTLDPGGLQCAWLRQMGG- SEQ ID NO: 9320 | (AL2) | (L11) | (AZ4) | -GGVVCQDWEGVELCWQGG SEQ ID NO: 9340 | -C(O)-NH₂ |
| C | C-N | H₂N- | GGHLGVPWCTLDPGSIQCAWLAKHGG- SEQ ID NO: 2601 | (AL2) | (L11) | (AZ4) | -GGVVCQDWEGVELCWQGG SEQ ID NO: 9340 | -C(O)-NH₂ |
| D | C-C | H₂N- | GGHLGVPWCTLDPGSIQCAWLAKHGG- SEQ ID NO: 2601 | (AL2) | (L10) | -NH₂ | GGVVCQDWEGVELCWQGG -SEQ ID NO: 9340 | (AZ5) |
| E | N-N | (AL4) | -GGHLGVPWCTLDPGSIQCAWLAKHGG SEQ ID NO: 2601 | -C(O)-NH₂ | (L8) | (AZ4) | -GGVVCQDWEGVELCWQGG SEQ ID NO: 9340 | -C(O)-NH₂ |
| F | N-C | (AL4) | -GGHLGVPWCTLDPGSIQCAWLAKHGG SEQ ID NO: 2601 | -C(O)-NH₂ | (L9) | -NH₂ | GGVVCQDWEGVELCWQGG -SEQ ID NO: 9340 | (AZ5) |
| G | C-C | H₂N- | QCVHWDLDTLFGCIREQLELGG- SEQ ID NO: 2602 | (AL2) | (L10) | -NH₂ | GGVVCQDWEGVELCWQGG -SEQ ID NO: 9340 | (AZ5) |

FIG. 38

SEQ ID NO: 8111 hIgG2
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGART (FP101) SEQ ID NO: 8112 hIgG2-Fc IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGSGSGSGSGSGSGSGSGSGSGGVH
RIPWCTLDPGGLQCAWLRQMGGGGSGGVVCQDWEGVELCWQGG (FP102) SEQ ID NO: 8113 hIgG1v-Fc IL-7Rαγc ligand fusion protein
AEPKSSDKTHTCPPCPAPEAAGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALGAPIEKTISKAKGQ
PREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGARTGGGGSGGGGSGGVHRIPWCTL
DPGGLQCAWLRQMGGGGSGGVVCQDWEGVELCWQGG (FP103) SEQ ID NO: 8114 hIgG4-Fc IL-7Rαγc ligand fusion protein
APPCPPCPAPEFEGGPSVFLFPPKPKDTLMISRTPEVTCVVVDVSQEDPEVQFNWYVDGVEVHNA
KTKPREEQFNSTYRVVSVLTVLHQDWLNGKEYKCKVSNKGLGSSIEKTISKAKGQPREPQVYTL
PPSQEEMTKNQVSLTCLVKGFYPSDIAVEWESNGQPENNYKTTPPVLDSDGSFFLYSRLTVDKSR
WQEGNVFSCSVMHEALHNHYTQKSLSLSLGARTGGGGSGGGGSGGVHRIPWCTLDPGGLQCA
WLRQMGGGGSGGVVCQDWEGVELCWQGG (FP4) SEQ ID NO: 8115 hIgG1-Fc (N-terminal fusion) IL-7Rαγc ligand fusion protein
GGVHRIPWCTLDPGGLQCAWLRQMGGGGSGGVVCQDWEGVELCWQGGGGGSGGGGSGGGGS
RSDKTHTCPPCPAPELLGGPSVFLFPPKPKDTLMISRTPEVTCVVVDVSHEDPEVKFNWYVDGVE
VHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK (FP105) SEQ ID NO: 8116 hIgG1-Fc-Knob IL-7Rαγc ligand fusion protein
GITVAEPKSCDKTHTCPPCPAPEAAGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALPAPIEKTISKA
KGQPREPQVYTLPPSREEMTKNQVSLWCLVKGFYPSDIAVEWESNGQPENNYKTTPPVLDSDGS
FFLYSKLTVDKSRWQQGNVFSCSVMHEALHNHYTQKSLSLSPGGGGGSGGGGSGGGGSGGVH
RIPWCTLDPGGLQCAWLRQMGGGGSGGVVCQDWEGVELCWQGG (FP106) SEQ ID NO 8117 hIgG1-Fc-Hole
EPKSCDKTHTCPPCPAPEAAGGPSVFLFPPKPKDTLMISRTPEVTCVVVDVSHEDPEVKFNWYV
DGVEVHNAKTKPREEQYNSTYRVVSVLTVLHQDWLNGKEYKCKVSNKALPAPIEKTISKAKGQ
PREPQVYTLPPSREEMTKNQVSLSCAVKGFYPSDIAVEWESNGQPENNYKTTPPVLDSDGSFFLV
SKLTVDKSRWQQGNVFSCSVMHEALHNHYTQKSLSLSPG

FIG. 39A (FP107) SEQ ID NO: 8118 Pembrolizumab-LC
EIVLTQSPATLSLSPGERATLSCRASKGVSTSGYSYLHWYQQKPGQAPRLLIYLASYLESGVPARF
SGSGSGTDFTLTISSLEPEDFAVYYCQHSRDLPLTFGGGTKVEIKRTVAAPSVFIFPPSDEQLKSGT
ASVVCLLNNFYPREAKVQWKVDNALQSGNSQESVTEQDSKDSTYSLSSTLTLSKADYEKHKVY
ACEVTHQGLSSPVTKSFNRGEC (FP108) SEQ ID NO: 8119 Pembrolizumab-HC- IL-7Rαγc ligand fusion protein
QVQLVQSGVEVKKPGASVKVSCKASGYTFTNYYMYWVRQAPGQGLEWMGGINPSNGGTNFN
EKFKNRVTLTTDSSTTTAYMELKSLQFDDTAVYYCARRDYRFDMGFDYWGQGTTVTVSSASTK
GPSVFPLAPCSRSTSESTAALGCLVKDYFPEPVTVSWNSGALTSGVHTFPAVLQSSGLYSLSSVVT
VPSSSLGTKTYTCNVDHKPSNTKVDKRVESKYGPPCPPCPAPEFLGGPSVFLFPPKPKDTLMISRTP
EVTCVVVDVSQEDPEVQFNWYVDGVEVHNAKTKPREEQFNSTYRVVSVLTVLHQDWLNGKEY
KCKVSNKGLPSSIEKTISKAKGQPREPQVYTLPPSQEEMTKNQVSLTCLVKGFYPSDIAVEWESN
GQPENNYKTTPPVLDSDGSFFLYSRLTVDKSRWQEGNVFSCSVMHEALHNHYTQKSLSLSLGAG
SGSGSGSGSGSGSGSGSGGVHRIPWCTLDPGGLQCAWLRQMGGGGSGGVVCQDWEGVELC
WQGG (FP113) SEQ ID NO: 8124 hIgG1-Fc (GS)10 (N297A mutant) IL-7Rαγc ligand fusion protein
DKTHTCPPCPAPELLGGPSVFLFPPKPKDTLMISRTPEVTCVVVDVSHEDPEVKFNWYVDGVEV
HNAKTKPREEQYASTYRVVSVLTVLHQDWLNGKEYKCKVSNKALPAPIEKTISKAKGQPREPQV
YTLPPSRDELTKNQVSLTCLVKGFYPSDIAVEWESNGQPENNYKTTPPVLDSDGSFFLYSKLTVD
KSRWQQGNVFSCSVMHEALHNHYTQKSLSLSPGAGSGSGSGSGSGSGSGSGSGSGGVHRIPWCT
L DPGGLQCAWLRQMGGGGSGGVVCQDWEGVELCWQGG (FP114) SEQ ID NO: 8125 hIgG2-Fc (GS)10 IL-7Rαγc ligand fusion protein
ERKSSVECPPCPAPPVAGPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTKGQPREPQV
YTLPPSREEMTKNQVSLTCLVKGFYPSDISVEWESNGQPENNYKTTPPMLDSDGSFFLYSKLTVD
KSRWQQGNVFSCSVMHEALHNHYTQKSLSLSPGAGSGSGSGSGSGSGSGSGSGSGGVHRIPWCT
LDPGGLQCAWLRQMGGGGSGGVVCQDWEGVELCWQGG (FP115) SEQ ID NO: 8126 hIgG2-Fc (PA)10 IL-7Rαγc ligand fusion protein
ERKSSVECPPCPAPPVAGPSVFLFPPKPKDTLMISRTPEVTCVVVDVSHEDPEVQFNWYVDGVEV
HNAKTKPREEQFNSTFRVVSVLTVVHQDWLNGKEYKCKVSNKGLPAPIEKTISKTKGQPREPQV
YTLPPSREEMTKNQVSLTCLVKGFYPSDISVEWESNGQPENNYKTTPPMLDSDGSFFLYSKLTVD
KSRWQQGNVFSCSVMHEALHNHYTQKSLSLSPGAPAPAPAPAPAPAPAPAPAGGVHRIPWCT
LDPGGLQCAWLRQMGGGGSGGVVCQDWEGVELCWQGG (FP116) SEQ ID NO: 8127 hIgG2-Fc (GGGGS)1 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE

FIG. 39B

PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGVHRIPWCTLDPGGLQCA
WLRQMGGGGSGGVVCQDWEGVELCWQGG (FP117) SEQ ID NO: 8128 hIgG2-Fc (GGGGS)3 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGSGGVHRIPW
CTLDPGGLQCAWLRQMGGGGSGGVVCQDWEGVELCWQGG (FP118) SEQ ID NO: 8129 hIgG2-Fc (GGGGS)4 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGSGGGGSGGGGSGGGGSGGV
HRIPWCTLDPGGLQCAWLRQMGGGGSGGVVCQDWEGVELCWQGG (FP119) SEQ ID NO: 8130 hIgG2-Fc (G)2 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGVHRIPWCTLDPGGLQCAWL
RQMGGGGSGGVVCQDWEGVELCWQGG (FP120) SEQ ID NO: 8131 hIgG2-Fc (G)5 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGGGGGGGVHRIPWCTLDPGGLQC
AWLRQMGGGGSGGVVCQDWEGVELCWQGG (FP121) SEQ ID NO: 8132 hIgG2-Fc (GS)10 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTGSGSGSGSGSGSGSGSGGVH
RIPWCTLDPGGLQCAWLRQMGGGGSGGVVCQDWEGVELCWQGG (FP122) SEQ ID NO: 8133 hIgG2-Fc (PA)5 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTPAPAPAPAPAGGVHRIPWCTLDPG
GLQCAWLRQMGGGGSGGVVCQDWEGVELCWQGG

FIG. 39C (FP123) SEQ ID NO: 8134 hIgG2-Fc (PA)10 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTPAPAPAPAPAPAPAPAPAPAGGVH
RIPWCTLDPGGLQCAWLRQMGGGGSGGVVCQDWEGVELCWQGG (FP124) SEQ ID NO: 8135 hIgG2-Fc (PA)7 IL-7Rαγc ligand fusion protein
APLERKSSVECPPCPAPPVAGPSVFLFPPKPKDTLMISRTPEVTCVVVDVSHEDPEVQFNWYVDG
VEVHNAKTKPREEQFNSTFRVVSVLTVVHQDWLNGKEYKCKVSNKGLPAPIEKTISKTKGQPRE
PQVYTLPPSREEMTKNQVSLTCLVKGFYPSDIAVEWESNGQPENNYKTTPPMLDSDGSFFLYSKL
TVDKSRWQQGNVFSCSVMHEALHNHYTQKSLSLSPGARTPAPAPAPAPAPAPAGGVHRIPWCTL
DPGGLQCAWLRQMGGGGSGGVVCQDWEGVELCWQGG (FP141) SEQ ID NO: 8152 HSA IL-7Rαγc ligand fusion protein
GGHHHHHHGGDAHKSEVAHRFKDLGEENFKALVLIAFAQYLQQCPFEDHVKLVNEVTEFAKTC
VADESAENCDKSLHTLFGDKLCTVATLRETYGEMADCCAKQEPERNECFLQHKDDNPNLPRLV
RPEVDVMCTAFHDNEETFLKKYLYEIARRHPYFYAPELLFFAKRYKAAFTECCQAADKAACLLP
KLDELRDEGKASSAKQRLKCASLQKFGERAFKAWAVARLSQRFPKAEFAEVSKLVTDLTKVHT
ECCHGDLLECADDRADLAKYICENQDSISSKLKECCEKPLLEKSHCIAEVENDEMPADLPSLAAD
FVESKDVCKNYAEAKDVFLGMFLYEYARRHPDYSVVLLLRLAKTYETTLEKCCAAADPHECYA
KVFDEFKPLVEEPQNLIKQNCELFEQLGEYKFQNALLVRYTKKVPQVSTPTLVEVSRNLGKVGS
KCCKHPEAKRMPCAEDYLSVVLNQLCVLHEKTPVSDRVTKCCTESLVNRRPCFSALEVDETYVP
KEFNAETFTFHADICTLSEKERQIKKQTALVELVKHKPKATKEQLKAVMDDFAAFVEKCCKADD
KETCFAEEGKKLVAASQAALGLRTGGGGSGGGGSGGVHRIPWCTLDPGGLQCAWLRQMGGGG
SGGVVCQDWEGVELCWQGG

FIG. 39D

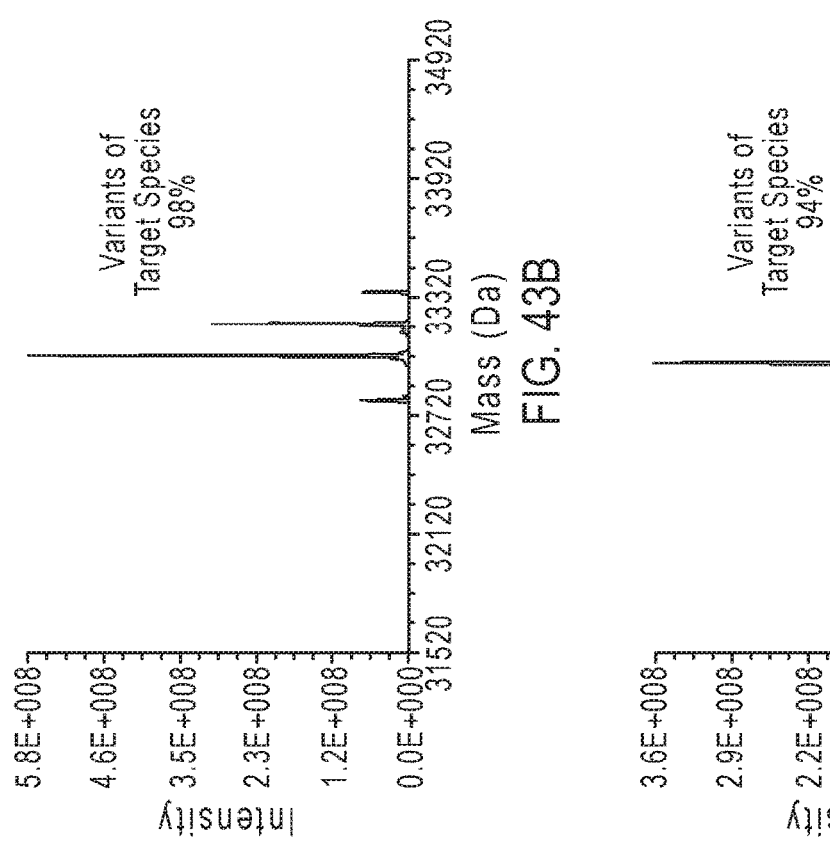
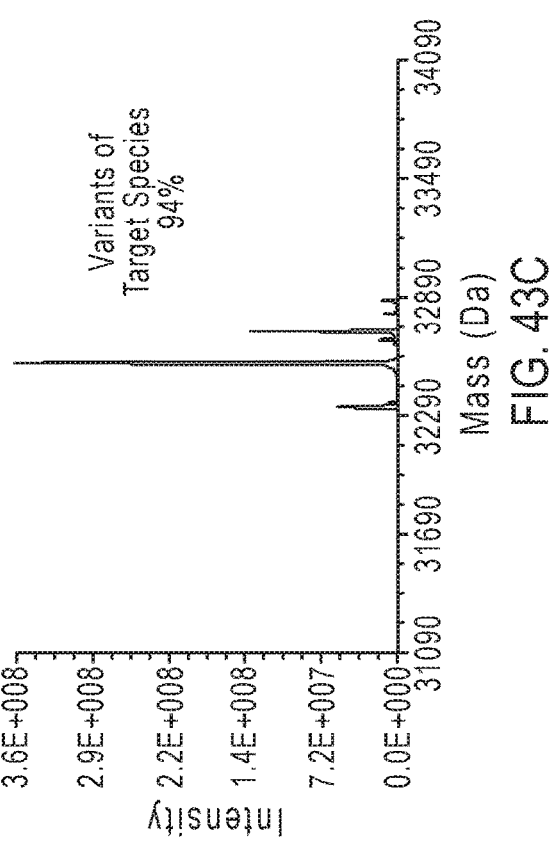
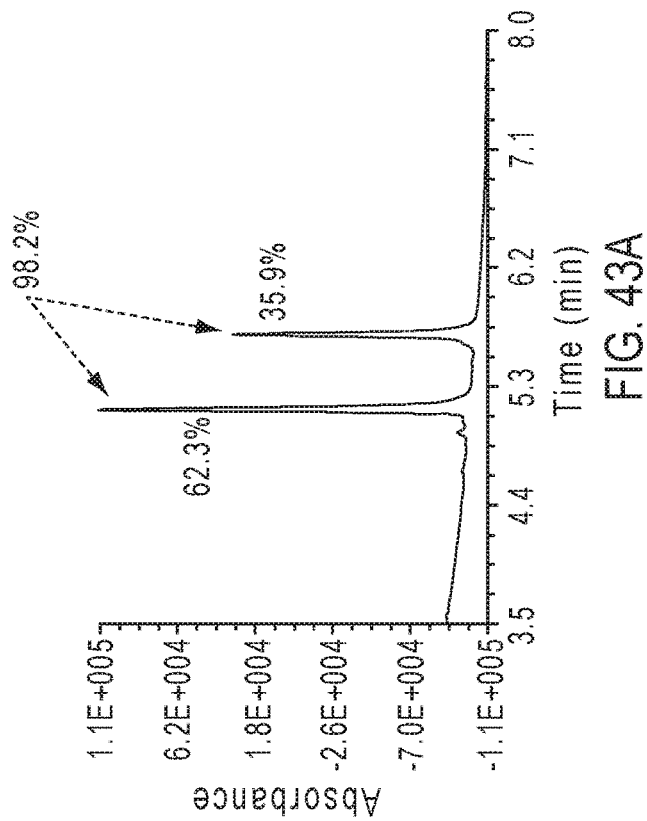
FIG. 43A
FIG. 43B
FIG. 43C

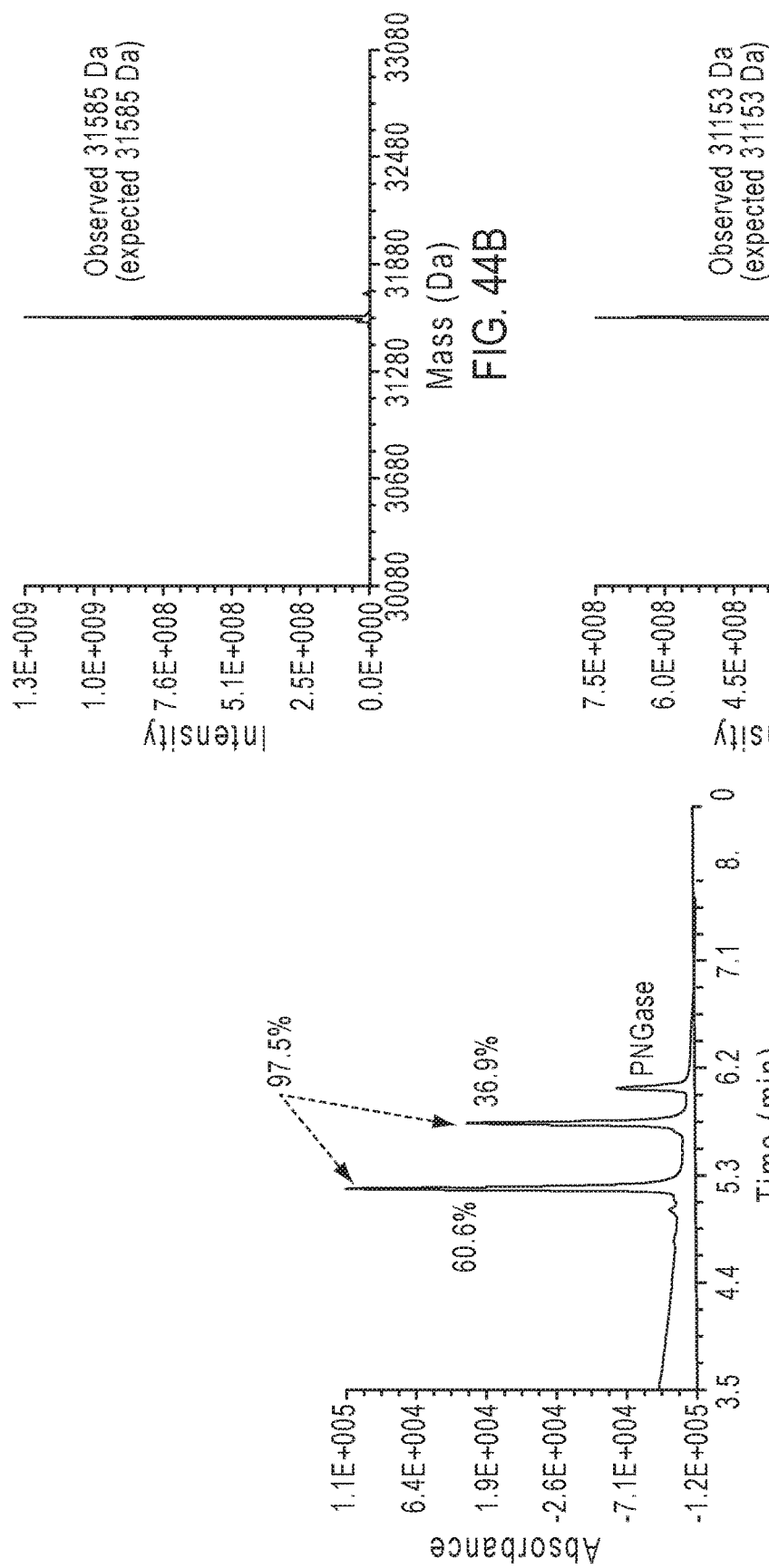
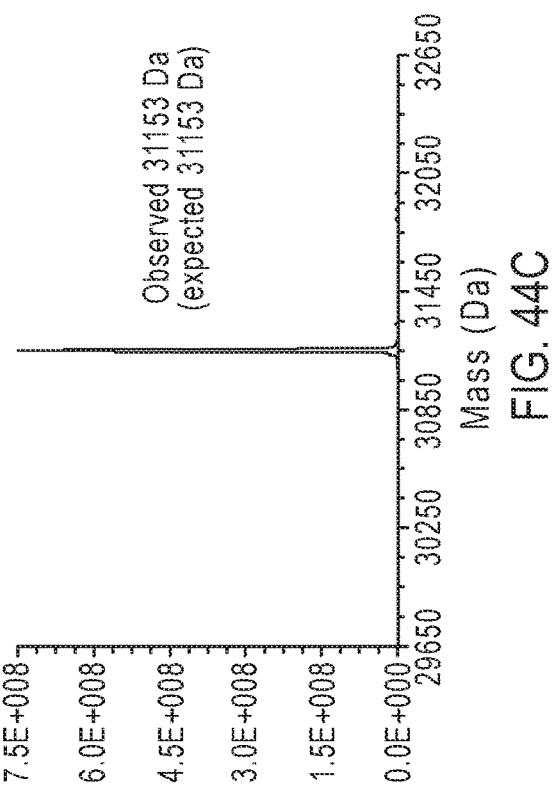
FIG. 44A
FIG. 44B
FIG. 44C

*PEG-5*

CH₃O-(CH₂CH₂O)$_{20kD}$ ...—C(O)—NH—(PEG20)-GGWYPCWMAQLGELCDLDGGGGSGGVVCQDWEGVELCWQGG-OH

*PEG-6*

CH₃O-(CH₂CH₂O)$_{40kD}$ ...—C(O)—NH—(PEG20)-GGWYPCWMAQLGELCDLDGGGGSGGVVCQDWEGVELCWQGG-OH

DUAL IL-2R AND IL-7R BINDING COMPOUNDS

This application claims the benefit under 35 U.S.C. § 119(e) of U.S. Provisional Application No. 63/071,946 filed on Aug. 28, 2020, U.S. Provisional Application No. 63/041,158 filed on Jun. 19, 2020, U.S. Provisional Application No. 62/969,432 filed on Feb. 3, 2020, and U.S. Provisional Application No. 62/930,758 filed on Nov. 5, 2019, each of which is incorporated by reference in its entirety.

FIELD

The disclosure relates to dual receptor binding compounds comprising IL-2Rβ, IL-7Rα, and Rγc ligands, and to pharmaceutical compositions comprising dual receptor binding compounds. The dual receptor binding compounds can act as IL-2R and IL-7R agonists and are useful in treating cancer, viral diseases, autoimmune diseases, and inflammatory diseases.

SEQUENCE LISTING

The Sequence Listing associated with this application is filed in electronic format via EFS-Web and is incorporated by reference in its entirety.

BACKGROUND

Recombinant human Interleukin-2 (IL-2) was one of the first immuno-oncology agents studied in the clinic and was approved by the United States Food and Drug Administration (FDA) for use against some particularly challenging cancers, melanoma and renal carcinoma in the 1990s. IL-2 is effective, producing durable responses in up to 10% of patients with these tumors, but its utility is limited by very serious, dose-limiting toxicities. In addition, the efficacy of IL-2 in directing T-cell-mediated anti-tumor response is compromised by concurrent IL-2-driven upregulation of T-cell suppressive systems. There has been a continuing search for strategies to reduce the toxicity of IL-2 therapy, and to avoid the immunosuppressive limitations on anti-tumor activity. To date, modestly effective strategies have been developed to control systemic exposure, and thus toxicity, of this potent biologic. Elucidation of the complicated biology of IL-2 has led to modifications of the natural IL-2 molecule to alter the balance of tumor toxicity and suppression. However, these approaches are limited by the use of natural IL-2 as a template, thus retaining elements of the undesirable, structure-driven bioactivities of the parent molecule.

Crucial to its anti-tumor properties, IL-2 exerts potent stimulatory effects on NK and cytotoxic CD8+ T-cells. However, the anti-tumor effects are paradoxically suppressed by IL-2-directed stimulation of T-regulatory cells (Tregs), which effectively suppresses the anti-tumor immune response. This dual effect of IL-2 is largely controlled by the nature of the IL-2 receptor (IL-2R) subunits expressed on the various cells responsible for immune homeostasis.

IL-2 is recognized by combinations of three receptor subunits, which are differentially and conditionally expressed on many types of immune cells. The two signaling subunits, known as IL-2Rβ (β) and IL-2Rγ-common (γc), initiate signaling when brought into correctly oriented apposition by binding to IL-2. IL-2 binds to IL-2Rβγc with an affinity of about 1 nM to form an active ternary complex. Most immune cells express, at various levels, the IL-2Rβ and IL-2Rγc subunits. There is also a third, non-signaling IL-2R subunit, IL-2Rα (also known as CD25), which is expressed on a subset of immune cells, notably Tregs. The ternary complex of IL-2Rαβγc has a very high affinity for IL-2 (an $IC_{50}$ of 10 pM), and cells expressing all three subunits are therefore much more sensitive to IL-2. A strategy for improving the efficacy of IL-2R agonists against tumors involves engineering IL-2R selectivity to reduce the binding of IL-2 to the IL-2Rα subunit while maintaining IL-2Rβγc binding and signaling to favor infiltration and stimulation of cytotoxic effector T-cells (Teff cells) over Tregs at tumor sites.

The cause of IL-2 toxicity in the clinical setting is less well understood but is thought to be the result of exaggerated peripheral immuno-stimulation of IL-2Rβγc-expressing T-cells accompanied by excessive release of inflammatory cytokines. Toxicity is induced by the frequent administration of high doses of IL-2 required to sustain adequate tumor exposure because of the short half-life of the natural cytokine.

Strategies to address the limitations of IL-2 as a useful immuno-oncology therapy utilize mutants, fusion proteins, or chemically modified IL-2 to alter the complex biology of the immune regulator. An example is a modified form of IL-2, decorated with six (6) large cleavable polyethylene glycol (PEG) moieties that serve the dual purposes of altering receptor subunit binding specificity and prolonging the circulating half-life of a reversibly inactive prodrug of IL-2. As the prodrug systemically circulates, a cascade of PEG removal imparts a complicated pharmacokinetic (PK) profile of variously active and inactive forms of the cytokine, producing low sustained peripheral exposure to active IL-2 agonism, and thereby avoids the $C_{max}$-driven severe side effects of high dose IL-2. The last two PEGs to be cleaved are located near the IL-2Rα binding site, interfering with IL-2Rα binding, but allowing for IL-2Rβγc signaling, consequently favoring cytotoxic T-cell activity over the suppressive Treg activity. This yields a promising therapeutic molecule that addresses two principal deficiencies of IL-2 as an anti-cancer therapeutic: (a) avoiding activation of IL-2Rαβγc on Tregs, and (b) half-life extension of the IL-2Rβγc-activating compound. However, these effects are interrelated and are difficult to optimize separately, as is often required during pre-clinical and clinical development. This limits the use of a bioactive IL-2 protein as a starting point for imparting multiple new properties.

Interleukin-7 (IL-7) is required for development and maintenance of T-cell homeostasis and plays an important role in the establishment of the B-cell repertoire. Unlike most interleukins, IL-7 is primarily produced by non-hematopoietic stromal cells rather than leukocytes. Under normal conditions, free IL-7 levels are limiting, but accumulate during conditions such as lymphopenia, leading to increased T-cell proliferation and replenishment of T-cell populations. Under certain physiological conditions, recombinant human IL-7 administered to humans, non-human primates and mice, produces widespread T-cell proliferation, increased T-cell numbers, modulation of peripheral T-cell subsets and increased T cell receptor diversity. These effects may be therapeutically useful in a variety of clinical settings.

IL-7 is a member of the common γ chain (γc, CD132) family of cytokines that includes interleukin-2 (IL-2), IL-4, IL-7, IL-9, IL-15, and IL-21. IL-7 signals via an active complex formed with its unique α-receptor, IL-7Rα (CD127), and the common γc receptor (Rγc). Receptor activation leads to signaling through an array of pathways, including JAK-STAT, P13K-AKT, and Src kinases.

The IL-7Rα receptor subunit exists in two states: a full-length membrane-bound form that, with Rγc, mediates IL-7R signal transduction; and soluble (alternatively-spliced, secreted, or shed) forms of the extracellular domain that may provide regulation of extracellular IL-7 levels and modulation of IL-7R signaling.

The cell surface signaling-competent form of IL-7Rα is expressed on most resting T-cells and is down regulated upon T-cell activation, while naïve memory T-cells continue to express IL-7Rα, and regulatory cells typically express very low levels of IL-7Rα. IL-7R signaling is necessary for long-term maintenance of T cell populations, in part by modulating apoptosis. Both CD4+ and CD8+ memory T-cells are dependent on IL-7 for long-term survival.

Emerging evidence suggests that IL-7R agonists may be useful in immuno-oncology therapy. For example, IL-7 is effective in increasing cytotoxic CD8+T lymphocytes (CD8+ T-cell), and long-term tumor antigen specific CD8+ T-cell responses are enhanced by IL-7 treatment.

IL-7 exhibits inhibitory effects in tumors such as glioma, melanoma, lymphoma, leukemia, prostate cancer, and glioblastoma; and administration of IL-7 in murine tumor models has shown to decrease cancer cell growth. IL-7 has been shown to enhance the antitumor effect of interferon-γ (IFNγ) in rat glioma tumors, and can induce the production of IL-1α, IL-1β, and TNF-α by monocytes, which can inhibit tumor growth.

IL-7 has also been shown to have potential in the treatment of lymphopenias, septic shock, and infectious disease as well immune deficiencies of aging (immuno-senescence), and enhancement of response to vaccination. IL-7 prevents or reverses T-cell exhaustion and induces rejuvenation and increased activity of transferred CAR-T cells. IL-7 is currently being studied to prevent or reverse lymphopenia associated with COVID-19. IL-7/IL-7R signaling has also been implicated in autoimmune, chronic inflammatory diseases, and cancer, and therefore therapeutic targeting of the IL-7/IL-7R pathway is expected to have clinical benefit.

Importantly, administration of recombinant IL-7 has been found to be well tolerated in clinical trials.

IL-2 is known to support effector T cell differentiation, proliferation and survival. IL-2 also stimulates regulatory T-cells expressing the high-affinity IL-2Ra. IL-2 does not mediate signals for resting naïve or memory T-cells but is a crucial growth factor for activated effector T-cells and is produced by activated lymphocytes. Tregs can prevent the antitumoral activity of tumor-specific effector T-cells that only transiently express IL-2Ra. IL-7 is a homeostatic cytokine that plays a role in lymphopoiesis, survival and memory formation, and can increase the expression of IL-2Rα on antigen-specific T-cells. IL-7 is a stromal cell-derived cytokine that provides continuous signals to resting naïve and memory T-cells but does not signal to most activated effector T-cells. Effector T-cells that are destined to enter the memory T-cell pool are an exception, as memory T-cells upregulate expression of IL-7Rα before the transition.

Studies in mice have demonstrated that the combination of IL-2 and IL-7 increases the number of a frequency of antigen-specific CD8+ T cells in combination with an antigen-specific RNA vaccine compared to the vaccine alone. For example, IL-2 expanded the number and frequency of Tregs and IL-7 reduced the fraction of Tregs among CD4+ cells. The combination of IL-2 and IL-7 increased the number of antigen-specific CD8+ cells compared to IL-2 alone, expanded CD8+ cells not specific for the vaccine-encoded target, and improved the ration of antigen-specific CD8+ T cells over Tregs.

These results support the complimentary additive or synergistic effects of combined IL-2 and IL-7 therapy in immuno-oncology.

SUMMARY

According the present invention, a dual receptor binding compound comprises: an IL-2Rβγc ligand, wherein the IL-2Rβγc ligand comprises an IL-2Rβ ligand and an Rγc ligand, and an IL-7Rαγc ligand, wherein the IL-7Rαγc ligand comprises an IL-7Rα ligand and an Rγc ligand; or an IL-2Rβ ligand, an IL-7Rα ligand, and an Rγc ligand.

According the present invention, a dual receptor binding compound, wherein the compounds binds to each of IL-2R and IL-7 with an $IC_{50}$ less than 100 μM.

According the present invention, a pharmaceutical composition comprises a dual receptor binding compound according to the present invention.

According the present invention, a method of treating a disease in a patient comprises administering to a patient in need of such treatment a therapeutically effective amount of the ligand of a dual receptor binding compound according to the present invention.

According the present invention, methods of expanding immune cells comprising contacting a population of immune cells ex vivo or in vivo with an effective amount of a dual receptor binding compound according to the present invention.

According the present invention, methods of boosting a vaccine comprise administering to a patient a vaccine and a therapeutically effective amount of a dual receptor binding compound according to the present invention.

According the present invention, method of modifying the immune response comprising administering to a patient an effective amount of a dual receptor binding compound according to the present invention.

According the present invention, nucleic acids encode for a dual receptor binding compound according to the present invention.

BRIEF DESCRIPTION OF THE DRAWINGS

The drawings described herein are for illustration purposes only. The drawings are not intended to limit the scope of the present disclosure.

In FIG. 5A the IL-2Rβ ligand is (BL4) (SEQ ID NO: 9301) and is coupled to different Rγc ligands. In FIG. 5B the Rγc ligand is (GL2) (SEQ ID NO: 9340) and is coupled to different IL-2Rβ ligands.

FIGS. 19A-19C show the amino acid sequences and linker structures for certain IL-2Rβγc ligands provided by the present disclosure. As shown in FIGS. 19A-19C, the IL-2Rβ ligand is coupled to the Rγc ligand through the linker structure (L). For example, in IL-2Rβγc ligand (BGL1) the C terminus of an IL-2Rβ ligand having SEQ ID NO: 558 is coupled to the C terminus of an Rγc ligand having SEQ ID NO: 1601 through a linker having the structure (L2). As described, IL-2Rβγc ligand (BGL1) is synthesized by reacting an IL-2Rβ ligand having SEQ ID NO: 558 with an $H_2N$-group on the N terminus and an alkyne moiety (AL1) on the C terminus, with an Rγc ligand having SEQ ID NO: 1601 with an $H_2N$-group on the N terminus and an azide moiety (AZ1) on the C terminus.

FIGS. 20A-20J show the amino acid sequences for certain IL-2Rβγc ligand fusion proteins.

FIGS. 21A-21C provides a summary of the sub-structures for the IL-2Rβγc ligand constructs provided in FIGS. 20A-20J. FIGS. 21A-C discloses "(G4S)$_2$" as SEQ ID NO: 9396, "(G4S)$_3$" as SEQ ID NO: 9397, "(GS)$_{10}$" as SEQ ID NO: 9407, "(PA)$_{10}$" as SEQ ID NO: 9428, "(G4S)$_1$" as SEQ ID NO: 9395, "(GGS)$_1$" as SEQ ID NO: 9402, "(G4S)$_4$" as SEQ ID NO: 9398, "(G)$_2$" as SEQ ID NO: 9399, "(G)$_5$" as SEQ ID NO: 9401, "(PA)$_5$" as SEQ ID NO: 9426 and "(PA)$_7$" as SEQ ID NO: 9427.

FIG. 38 shows the amino acid sequences and linker structures for certain IL-7Rαγc ligands.

FIGS. 39A-39D show the amino acid sequences for certain protein and IL-7Rαγc ligand fusion constructs.

FIG. 43A shows an RP-HPLC of the dual receptor binding heterodimer Fc ligand construct as described in Example 42.

FIGS. 43B and 43C show mass spectra of the primary and secondary HPLC fractions shown in FIG. 43A.

FIG. 44A shows a RP-HPLC of the reduced and deglycosylated heterodimer construct of Example 43.

FIGS. 44B and 44C show the mass spectra of the primary and secondary RP-HPLC fractions shown in FIG. 44A.

DETAILED DESCRIPTION

Definitions

Figure 1:
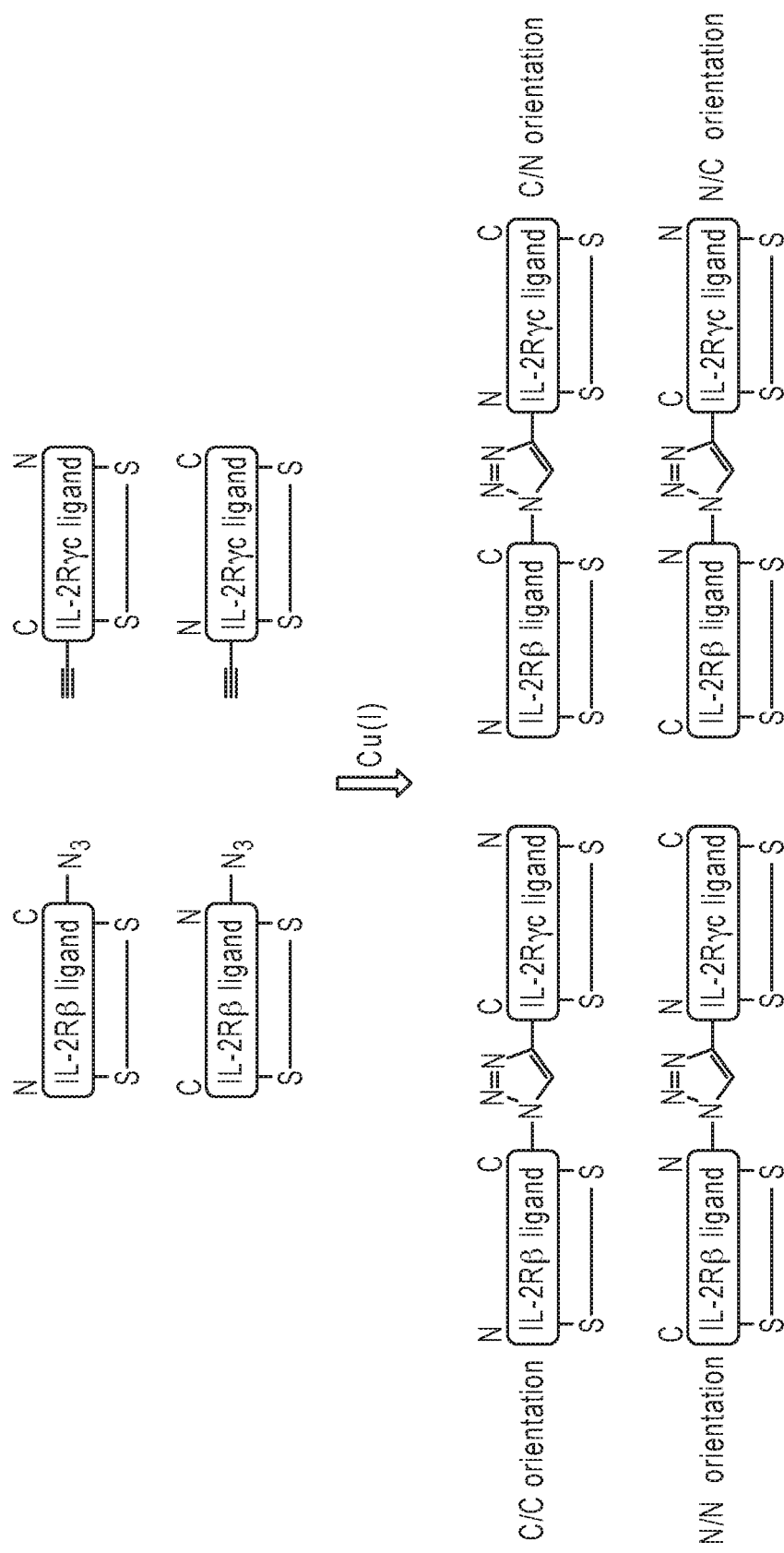
FIG. 1 shows examples of IL-2Rβγc ligands having different C/N orientations of an IL-2Rβ ligand and an Rγc ligand.

A dash ("-") that is not between two letters or symbols is used to indicate a point of attachment for a moiety or substituent. For example, —$CONH_2$ is attached to a compound through the carbon atom and —$X^1$—$X^2$— denotes amino acids $X^1$ and $X^2$ covalently bound through a single bond.

"Cycloalkyl" refers to a saturated or partially unsaturated cyclic alkyl radical. A cycloalkyl can be, for example, $C_{3-6}$ cycloalkyl, $C_{3-5}$ cycloalkyl, $C_{56}$ cycloalkyl, cyclopropyl, cyclopentyl, and in certain embodiments, cyclohexyl. Cycloalkyl can be selected from cyclopropyl, cyclobutyl, cyclopentyl, and cyclohexyl.

"Cyclized" refers to a reaction in which one part of a peptide or polypeptide molecule becomes linked to another part of the peptide or polypeptide molecule to form a closed ring, such as by forming a disulfide bridge or other similar bond, such as a lactam bond. Peptide monomer compounds or monomer subunits of peptide dimer compounds can be cyclized via an intramolecular bond between two amino acid residues present in the peptide monomer or monomer subunit. A peptide such as an IL-2Rβγc ligand or an IL-7Rαγc ligand can include cysteines that are bound together through disulfide bonds and thereby are cyclized IL-2Rβγc ligands and IL-7Rαγc ligands.

"Heterocycloalkyl" by itself or as part of another substituent refers to a saturated cyclic alkyl radical in which one or more carbon atoms (and certain associated hydrogen atoms) are independently replaced with the same or different heteroatom; or to a parent aromatic ring system in which one or more carbon atoms (and certain associated hydrogen atoms) are independently replaced with the same or different heteroatom such that the ring system violates the Hückel-rule. Examples of heteroatoms to replace the carbon atom(s) include N, P, O, S, and Si. Examples of heterocycloalkyl groups include groups derived from epoxides, azirines, thiiranes, imidazolidine, morpholine, piperazine, piperidine, pyrazolidine, pyrrolidine, quinuclidine, and the like. A heterocycloalkyl can be $C_5$ heterocycloalkyl and is selected from pyrrolidinyl, tetrahydrofuranyl, tetrahydrothiophenyl, imidazolidinyl, oxazolidinyl, thiazolidinyl, doxolanyl, and dithiolanyl. A heterocycloalkyl can be $C_6$ heterocycloalkyl and is selected from piperidinyl, tetrahydropyranyl, piperizinyl, oxazinyl, dithianyl, and dioxanyl. A heterocycloalkyl group can be $C_{3-6}$ heterocycloalkyl, $C_{3-5}$ heterocycloalkyl, $C_{5,6}$ heterocycloalkyl, and in certain embodiments, $C_5$ heterocycloalkyl or $C_6$ heterocycloalkyl. A heteroatomic group can be selected from —O—, —S—, —NH—, —N(—CH$_3$)—, —SO—, and —SO$_2$—, in certain embodiments, a heteroatomic group is selected from —O— and —NH—, and in certain embodiments a heteroatomic group is —O— or —NH—.

"Binding affinity" refers to the strength of the binding interaction between a single biomolecule and its ligand/binding partner. Binding affinity is expressed as the IC$_{50}$. For example, binding affinity of a compound such as a dual receptor binding compound refers to the IC$_{50}$ as determined using, for example, a method described in the examples.

"Direct binding" refers to the binding interaction between a single biomolecule and its binding partner such as the interaction of a dual receptor binding compound and IL-2R and/or IL-7R. Direct binding can be determined using phage ELISA assays.

"Agonist" refers to a biologically active ligand which binds to its complementary biologically active receptor or subunit(s) and activates the receptor to cause a biological response mediated by the receptor, or to enhance a preexisting biological activity mediated by the receptor.

"Partial agonist" refers to a compound that provides a level of activation, that is, for example, less than 75% of maximum activation, less than 50%, less than 25%, less than 10%, or less than 1% of the maximum activation. For example, a partial IL-2R agonist exhibits a level of activation that is less than the level of activation provided by IL-2 and a partial IL-7R agonist exhibits a level of activation that is less than the level of activation provided by IL-7.

"Antagonist" refers to a biologically active ligand or compound that binds to its complementary receptor or subunit(s) and blocks or reduces a biological response of the receptor. For example, an IL-2R antagonist can bind to IL-2R with an IC$_{50}$ of less than 100 µM and can inhibit functional activity of IL-2 as determined, for example, using any of the functional assays disclosed in the examples. For example, an IL-7R antagonist can bind to IL-7R with an IC$_{50}$ of less than 100 µM and can inhibit functional activity of IL-7 as determined, for example, using any of the functional assays disclosed in the examples.

Amino acid residues are abbreviated as follows: alanine is Ala or A; arginine is Arg or R; asparagine is Asn or N; aspartic acid is Asp or D; cysteine is Cys or C; glutamic acid is Glu or E; glutamine is Gln or Q; glycine is Gly or G; histidine is His or H; isoleucine is Ile or I; leucine is Leu or L; lysine is Lys or K; methionine is Met or M; phenylalanine is Phe or F; proline is Pro or P; serine is Ser or S; threonine is Thr or T; tryptophan is Trp or W; tyrosine is Tyr or Y; and valine is Val or V.

"Non-natural amino acids" include, for example, f-amino acids, homo-amino acids, proline and pyruvic acid derivatives, histidine derivatives with alkyl or heteroatom moieties attached to the imidazole ring, amino acids with pyridine-containing side chains, 3-substituted alanine derivatives, glycine derivatives, ring-substituted phenylalanine and tyrosine derivatives, and N-methyl amino acids.

Amino acids having a large hydrophobic side chain include isoleucine (I), leucine (L), methionine (M), valine (V), phenylalanine (F), tyrosine (Y), and tryptophan (W).

Amino acids having a small hydrophobic side chain include alanine (A), glycine (G), proline (P), serine (S), and threonine (T).

Amino acids having a basic side chain include arginine (R), lysine (K), and histidine (H).

Amino acids having an acidic side chain include aspartate (D) and glutamate (E).

Amino acids having a polar/neutral side chain include histidine (H), asparagine (N), glutamine (Q), serine (S), threonine (T), and tyrosine (Y).

Amino acids having an aromatic side chain include phenylalanine (F), histidine (H), tryptophan (W), and tyrosine (Y).

Amino acids having a hydroxyl side chain include serine (S), threonine (T), and tyrosine (Y).

"Conservative amino acid substitution" means that amino acids within each of the following groups can be substituted with another amino acid within the group: amino acids having a small hydrophobic side chain comprising alanine (A), glycine (G), proline (P), serine (S), and threonine (T); amino acids having a hydroxyl-containing side chain comprising serine (S), threonine (T), and tyrosine (Y); amino acids having an acidic side chain comprising aspartate (D) and glutamate (E); amino acids comprising a polar-neutral side chain comprising histidine (H), asparagine (N), glutamine (Q), serine (S), threonine (T), and tyrosine (Y); amino acids having a basic side chain comprising arginine (R), lysine (K), and histidine (H); amino acids having a large hydrophobic side chain comprising isoleucine (I), leucine (L), methionine (M), valine (V), phenylalanine (F), tyrosine (Y), and tryptophan (W); and amino acids having an aromatic side chain comprising phenylalanine (F), histidine (H), tryptophan (W), and tyrosine (Y).

An "enzymatically degradable linkage" refers to a chemical linkage that can be degraded or cleaved by one or more enzymes.

A "hydrolytically stable" linkage or bond refers to a chemical bond, such as a covalent bond, that is substantially stable in water such that the chemical bond does not undergo hydrolysis under physiological conditions to any appreciable extent over an extended period. Examples of hydrolytically stable linkages include, but are not limited to, the following: carbon-carbon bonds (e.g., in aliphatic chains), ethers, amides, urethanes, and the like. Generally, a hydrolytically stable linkage is one that exhibits a rate of hydrolysis of less than about 1% to 2% per day under physiological conditions.

An "IL-2Rβ ligand" refers to a peptide capable of binding to the IL-2Rβ subunit of a mammalian IL-2 receptor, such as a human IL-2 receptor, with an IC$_{50}$ of less than 100 µM, such as less than 10 µM, or less than 1 µM.

An "IL-7Rα ligand" refers to a peptide capable of binding to the IL-7Rα subunit of a mammalian IL-7 receptor, such as a human IL-7 receptor, with an IC$_{50}$ of less than 100 µM, such as less than 10 µM, or less than 1 µM.

An "Rγc ligand" refers to a peptide capable of binding to the Rγc subunit of a mammalian Rγc receptor, such as a human Rγc receptor, with an IC$_{50}$ of less than 100 µM, such as less than 10 µM, or less than 1 µM.

The "hIL-2Rβ subunit" refers to the human (*Homo sapiens*) interleukin-2 receptor subunit R precursor NCBI Reference Sequence NP_000689.1.

The "hIL-7Rα subunit" refers to the human (*Homo sapiens*) interleukin-7 receptor subunit α precursor NCBI Reference Sequence NP_002176.2.

The "hRγc subunit" refers to the human (*Homo sapiens*) interleukin-7 receptor subunit γc precursor NCBI Reference Sequence NP_000197.1.

The "cyano-IL-2Rβ subunit" refers to the cynomolgus monkey interleukin-2 receptor subunit R precursor NCBI Reference Sequence NP_001244989.1.

The "cyano-IL-2Rγc subunit" refers to the cynomolgus monkey interleukin-2 receptor subunit γc precursor NCBI Reference Sequence XP_005593949.

The cyano IL-7Rα subunit refers to the cynomolgus monkey interleukin-7 receptor a precursor, Accession No. NP_001271837.1 (ECD Met1-Pro235) and was obtained from Sino Biological Inc., product number 90332-C08H.

A "ligand fusion protein" refers to a protein made by recombinant DNA technology in which the translational reading frame of a ligand of a mammalian receptor is fused in frame to that of another protein, i.e., the fusion partner, to produce a single recombinant polypeptide. A ligand fusion protein can comprise, for example, an IL-2Rβ ligand, an IL-7Rα ligand, an Rγc ligand, an IL-2Rβγc ligand, an IL-7Rαγc ligand, and/or a receptor binding ligand provided by the present disclosure bound to a fusion partner. A fusion partner can be, for example, the Fc domain of an IgG molecule where the ligand is bound to one or both C-termini of the Fc structure. A ligand fusion protein can include a peptidyl linker such as an amino acid sequence located between a ligand and a fusion protein partner comprising a fusion protein, such that the peptidyl linker amino acid sequence is not derived from either the ligand or the fusion protein partner. Peptidyl linkers can be incorporated into fusion proteins as spacers to promote proper protein folding and stability of the component protein moieties, to improve protein expression, and/or to enable better bioactivity of the two fusion partners. Peptidyl linkers can include, for example, a flexible peptide or a rigid peptide.

An "IL-2Rβγc ligand" refers to a compound consisting of or comprising one or more IL-2Rβ ligands and one or more Rγc ligands. The one or more IL-2Rβ ligands and one or more Rγc ligands can be bound to a ligand linker. An IL-2Rβγc ligand can comprise a tandem IL-2Rβγc ligand comprising two or more IL-2Rβγc ligands. An IL-2Rβγc ligand can simultaneously bind to both the IL-2Rβ subunit and to the Rγc subunit. An IL-2Rβγc ligand is capable of binding to the IL-2Rβ subunit and to the Rγc subunit of IL-2R with an $IC_{50}$ of less than 100 μM.

An "IL-7Rαγc ligand" refers to a compound consisting of or comprising one or more IL-7Rα ligands and one or more Rγc ligands. The one or more IL-7Rα ligands and one or more Rγc ligands can be bound to an IL-7Rαγc ligand linker. An IL-7Rαγc ligand can comprise a tandem IL-7Rαγc ligand comprising two or more IL-7Rαγc ligands, or an IL-7Rαγc ligand can comprise a single ligand that simultaneously binds to both the IL-7Rα subunit and to the Rγc subunit. An IL-7Rαγc ligand is capable of binding to the IL-7Rα subunit and to the Rγc subunit of IL-7R with an $IC_{50}$ of less than 100 μM.

A "dual receptor binding ligand" refers to a ligand comprising an IL-2Rβ ligand, an IL-7Rα ligand, and an Rγc ligand, and that binds to both IL-2R and IL-7R with an $IC_{50}$ of less than 100, such as less than 10 μM, or less than 1 μM. A dual receptor binding ligand can be a linear dual receptor binding ligand or a branched dual receptor binding ligand.

A "dual receptor binding compound" refers to a compound capable of binding to both IL-2R and IL-7R. More specifically, a dual receptor binding compound is a compound capable of binding to the IL-2Rβ and Rγc subunits of IL-2R; and to the IL-7Rα and Rγc subunits of IL-7R. A dual receptor binding compound is a compound that binds to each of IL-2R and IL-7R with an $IC_{50}$ of less than 100 μM, such as less than 10 μM, or less than 1 μM. For example, a dual receptor binding compound can bind to the IL-2Rβ subunit and to the Rγc subunit of IL-2R with an $IC_{50}$ of less than 100 μM, such as less than 10 μM, and to the IL-7Rα subunit and the Rγc subunit of IL-7R with an $IC_{50}$ of less than 100 μM, such as less than 10 μM. A dual receptor binding compound comprises at least one IL-2Rβ ligand, at least one IL-7Rα ligand, and at least one Rγc ligand. A dual receptor binding compound can comprise at least one IL-2Rβγc ligand and at least one IL-7Rαγc ligand. A dual receptor binding compound can comprise at least one dual receptor binding ligand. A dual receptor binding compound can comprise at least one dual receptor binding ligand and at least one IL-2Rβγc ligand and/or at least one IL-7Rαγc ligand. A dual receptor binding compound can be a dual receptor binding construct.

A "dual receptor binding construct" refers to a dual receptor binding compound in which at least one IL-2Rβ ligand, at least one IL-7Rα ligand, and at least one Rγc ligand are bound to a molecule such as, for example, a polymer, a protein, an immunoglobulin, or an immunoglobulin fragment. A dual receptor binding construct can comprise at least one IL-2Rβγc ligand and at least one IL-7Rαγc ligand bound to a construct partner. A dual receptor binding construct can comprise at least one dual receptor binding ligand bound to a construct partner.

A "linear dual receptor binding ligand" refers to a dual receptor binding ligand in which an IL-2Rβ ligand, an IL-7Rα ligand, and an Rγc ligand are bound to each other directly or through a ligand linker in a linear configuration.

A "branched dual receptor binding ligand" refers to a dual receptor binding ligand in which an IL-2Rβ ligand, an IL-2Rα ligand and an Rγc ligand are bound to common molecule or moiety.

Bioisosteres are atoms or molecules that fit the broadest definition for isosteres. The concept of bioisosterism is based on the concept that single atom, groups, moieties, or whole molecules, which have chemical and physical similarities produce similar biological effects. A bioisostere of a parent compound can still be recognized and accepted by its appropriate target, but its functions will be altered as compared to the parent molecule. Parameters influenced by bioisosteric replacements include, for example, size, conformation, inductive and mesomeric effects, polarizability, capacity for electrostatic interactions, charge distribution, H-bond formation capacity, pKa (acidity), solubility, hydrophobicity, lipophilicity, hydrophilicity, polarity, potency, selectivity, reactivity, or chemical and metabolic stability, ADME (absorption, distribution, metabolism, and excretion). Although common in pharmaceuticals, carboxyl groups or carboxylic acid functional groups ($-CO_2H$) in a parent molecule may be replaced with a suitable surrogate or (bio)isostere to overcome chemical or biological shortcomings while retaining the desired attributes of the parent molecule bearing one or more carboxyl groups or carboxylic acid functional groups ($-CO_2H$). Ligands provided by the present disclosure include bioisosteres of the disclosed ligands.

"Isostere" or "isostere replacement" refers to any amino acid or other analog moiety having physiochemical and/or structural properties similar to a specified amino acid. An "isostere" or "suitable isostere" of an amino acid is another amino acid of the same class, wherein amino acids belong to the following classes based on the propensity of the side chain to be in contact with polar solvent like water: hydrophobic (low propensity to be in contact with water), polar or charged (energetically favorable contact with water). Examples of charged amino acid residues include lysine (+), arginine (+), aspartate (−) and glutamate (−). Examples of polar amino acids include serine, threonine, asparagine, glutamine, histidine and tyrosine. Illustrative hydrophobic amino acids include alanine, valine, leucine, isoleucine, proline, phenylalanine, tryptophan, cysteine and methionine. The amino acid glycine does not have a side chain and is difficult to assign to one of the above classes. However, glycine is often found at the surface of proteins, often within loops, providing high flexibility to these regions, and an isostere may have a similar feature. Proline has the opposite effect, providing rigidity to the protein structure by imposing certain torsion angles on the segment of the polypeptide chain. An isostere can be a derivative of an amino acid, e.g., a derivative having one or more modified side chains as compared to the reference amino acid. Ligands include isosteres of the ligands provided by the present disclosure.

A ligand linker refers to a moiety that binds at least one ligand such as an IL-2Rβ ligand, an IL-7Rα ligand, and/or an Rγc ligand to another ligand such as to an IL-2Rβ ligand, an IL-7Rα ligand and/or to an Rγc ligand. A ligand linker can bind to another ligand which can be the same ligand or can be a different ligand. A ligand linker can be divalent or multivalent. A ligand linker can be hydrolytically stable or can include a physiologically hydrolyzable or enzymatically degradable ligand linkage. A ligand linker can bind ligands to form dimers, trimers, or higher order multi-ligand peptides (heteromers) and compounds. A ligand linker can be a peptidyl ligand linker or a chemical ligand linker. As an example, an IL-7Rαγc ligand can comprise an IL-7Rα ligand bound to a ligand linker and an Rγc ligand bound to the ligand linker.

"Patient" refers to a mammal, for example, a human.

"PEG," "polyethylene glycol" and "poly(ethylene glycol)" refer to any suitable nonpeptidic water-soluble poly (ethylene oxide). PEGs can comprise a structure —(OCH$_2$CH$_2$)$_n$— where n is, for example, an integer from 1 to 4,000. A PEG can also include moieties such as —CH$_2$CH$_2$—O(CH$_2$CH$_2$O)—CH$_2$CH$_2$— and/or —(OCH$_2$CH$_2$)$_n$O—, depending upon whether or not the terminal oxygens have been displaced, e.g., during a synthetic transformation. A PEG can be capped with a suitable end group. At least 50% of the repeating subunits of a PEG can have the structure —CH$_2$CH$_2$—. A PEG can have any suitable molecular weight, structure, and/or geometry such as branched, linear, forked, or multifunctional.

"Peptide" refers to a polymer in which the monomers include amino acids joined together through amide bonds. A peptide can comprise, for example, less than 200 amino acids, less than 100 amino acids, less than 50 amino acids, less than 40 amino acids, less than 30 amino acids, or less than 20 amino acids. A peptide can comprise naturally occurring amino acids, non-naturally occurring amino acids, or a combination thereof.

In addition to peptides consisting only of naturally occurring amino acids, peptidomimetics or peptide analogs are also provided. A peptide mimetic can be functionally and/or structurally similar to another peptide. Peptide mimetics that are functionally and/or structurally similar to therapeutically useful peptides may be used to produce an equivalent or enhanced therapeutic or prophylactic effect. Generally, peptidomimetics can be structurally similar to a paradigm peptide, for example, a peptide that has a biological or pharmacological activity, such as a naturally occurring receptor-binding peptide, but have one or more peptide linkages optionally replaced by a linkage such as —CH$_2$—NH—, —CH$_2$—S—, —CH$_2$—CH$_2$—, —CH=CH— (cis and trans), —COCH$_2$—, —CH(OH)CH$_2$—, and —CH$_2$SO—, by methods known in the art.

Substitution of one or more amino acids of a consensus sequence with a D-amino acid of the same type, such as D-lysine in place of L-lysine, can be used to generate more stable peptides. In addition, constrained peptides comprising a consensus sequence, or a substantially identical consensus sequence variation may be generated by methods known in the art; for example, by adding internal cysteine residues capable of forming intramolecular disulfide bridges which cyclize the peptide.

Synthetic or non-naturally occurring amino acids refer to amino acids that do not naturally occur in vivo but which, nevertheless, can be incorporated into the peptide ligands provided by the present disclosure. Suitable examples of synthetic amino acids include the D-α-amino acids of naturally occurring L-α-amino acid as well as non-naturally occurring D- and L-α-amino acids represented by the formula H$_2$NCHRCOOH where R is $C_{1-6}$ alkyl, $C_{3-8}$ cycloalkyl, $C_{3-8}$ heterocycloalkyl; an aromatic residue of from 6 to 10 carbon atoms optionally having from 1 to 3 substituents on the aromatic nucleus selected from hydroxyl, lower alkoxy, amino, and carboxyl; -alkylene-Y where alkylene is an alkylene group of from 1 to 7 carbon atoms and Y is selected from a hydroxyl, amino, cycloalkyl, and cycloalkenyl having from 3 to 7 carbon atoms; aryl of from 6 to 10 carbon atoms, such as from 1 to 3 substituents on the aromatic nucleus selected hydroxyl, lower alkoxy, amino and carboxyl; heterocyclic of from 3 to 7 carbon atoms and 1 to 2 heteroatoms selected from oxygen, sulfur, and nitrogen; —C(O)R where R is selected from hydrogen, hydroxy, lower alkyl, lower alkoxy, and —N(R)$_2$ where each R is independently selected from hydrogen and lower alkyl; —S(O)$_n$R where n is 1 or 2 and R is $C_{1-6}$ alkyl, and with the proviso that R does not define a side chain of a naturally occurring amino acid.

Examples of other synthetic amino acids include amino acids in which the amino group is separated from the carboxyl group by more than one carbon atom such as β-alanine and γ-aminobutyric acid.

Examples of suitable synthetic amino acids include the D-amino acids of naturally occurring L-amino acids, L-1-naphthyl-alanine, L-2-naphthylalanine, L-cyclohexylalanine, L-2-amino isobutyric acid, the sulfoxide and sulfone derivatives of methionine, such as HOOC—(H$_2$NCH)CH$_2$CH$_2$—S(O)$_n$R, where n and R are as defined above as well as the lower alkoxy derivative of methionine, such as HOOC—(H$_2$NCH)CH$_2$CH$_2$OR where R is as defined above.

"N-terminus" refers to the end of a peptide or polypeptide, such as an N-terminus of an IL-2Rβγc ligand, an IL-2Rβγc ligand construct, an IL-7Rαγc ligand, an IL-7Rαγc ligand construct, an IL-7Rα ligand, an Rγc ligand, or a dual receptor binding ligand that bears an amino group in contrast to the carboxyl end bearing a carboxylic acid group.

"C-terminus" refers to the end of a peptide or polypeptide, such as a C-terminus of an IL-2Rβγc ligand, an IL-2Rβγc ligand construct, an IL-7Rαγc ligand, an IL-7Rαγc ligand construct, an IL-7Rα ligand, an Rγc ligand, or a dual receptor binding ligand, that bears a carboxylic acid group in contrast to the amino terminus bearing an amino group. In certain synthetic peptides, the N-terminus does not bear an amino group and/or the C-terminus does not bear a carboxyl group. In such cases the nomenclature refers to the direction of the peptide backbone.

"Pharmaceutically acceptable" refers to approved or approvable by a regulatory agency of the Federal or a state government or listed in the U.S. Pharmacopoeia or other generally recognized pharmacopoeia for use in animals, and more particularly in humans.

"Pharmaceutically acceptable salt" refers to a salt of a compound, which possesses a desired pharmacological activity of the parent compound. Such salts include acid addition salts, formed with inorganic acids and one or more protonate-able functional groups such as primary, secondary, or tertiary amines within the parent compound. Examples of inorganic acids include hydrochloric acid, hydrobromic acid, sulfuric acid, nitric acid, and phosphoric acid. A salt can be formed with organic acids such as, for example, acetic acid, propionic acid, hexanoic acid, cyclopentanepropionic acid, glycolic acid, pyruvic acid, lactic acid, malonic acid, succinic acid, malic acid, maleic acid, fumaric acid, tartaric acid, citric acid, benzoic acid, 3-(4-hydroxybenzoyl) benzoic acid, cinnamic acid, mandelic acid, methanesulfonic acid, ethanesulfonic acid, 1,2-ethane-disulfonic acid, 2-hydroxyethanesulfonic acid, benzenesulfonic acid, 4-chlorobenzenesulfonic acid, 2-naphthalenesulfonic acid, 4-toluenesulfonic acid, camphorsulfonic acid, 4-methylbicyclo [2.2.2]-oct-2-ene-1-carboxylic acid, glucoheptonic acid, 3-phenylpropionic acid, trimethylacetic acid, tertiary butylacetic acid, lauryl sulfuric acid, gluconic acid, glutamic acid, hydroxynaphthoic acid, salicylic acid, stearic acid, or muconic acid. A salt can be formed when one or more acidic protons present in the parent compound are replaced by a metal ion, e.g., an alkali metal ion, an alkaline earth ion, or an aluminum ion, or combinations thereof; or coordinates with an organic base such as ethanolamine, diethanolamine, triethanolamine, or N-methylglucamine. A pharmaceutically acceptable salt can be a hydrochloride salt. A pharmaceutically acceptable salt can be a sodium salt. A compound can have two or more ionizable groups, and a pharmaceutically acceptable salt can comprise one or more counterions, such as a bi-salt, for example, a dihydrochloride salt.

"Pharmaceutically acceptable salt" refers to hydrates and other solvates, as well as salts in crystalline or non-crystalline form. Where a particular pharmaceutically acceptable salt is disclosed, it is understood that the particular salt (e.g., a hydrochloride salt) is an example of a salt, and that other salts may be formed using techniques known to one of skill in the art. Additionally, a pharmaceutically acceptable salt to the corresponding compound, free base and/or free acid, using techniques generally known in the art. See also: Stahl and Wermuth, C. G. (Editors), Handbook of Pharmaceutical Salts, Wiley-VCH, Weinheim, Germany, 2008.

"Pharmaceutically acceptable vehicle" refers to a pharmaceutically acceptable diluent, a pharmaceutically acceptable adjuvant, a pharmaceutically acceptable excipient, a pharmaceutically acceptable carrier, or a combination of any of the foregoing with which a compound provided by the present disclosure may be administered to a patient and which does not destroy the pharmacological activity thereof and which is non-toxic when administered in doses sufficient to provide a therapeutically effective amount of the compound.

"Pharmaceutical composition" refers to a composition comprising a binding compound such as a dual receptor binding compound provided by the present disclosure and at least one pharmaceutically acceptable vehicle with which the binding compound is administered to a patient.

A "physiologically cleavable" or "hydrolyzable" or "degradable" bond is a bond that reacts with water (i.e., is hydrolyzed) under physiological conditions. The tendency of a bond to hydrolyze in water will depend not only on the general type of linkage connecting two central atoms but also on the substituents attached to these central atoms. Suitable hydrolytically unstable or weak linkages include, for example, carboxylate ester, phosphate ester, anhydrides, acetals, ketals, acyloxyalkyl ether, imines, orthoesters, peptides, and oligonucleotides.

"Preventing" or "prevention" refers to a reduction in risk of acquiring a disease or disorder (i.e., causing at least one of the clinical symptoms of the disease not to develop in a patient that may be exposed to or predisposed to the disease but does not yet experience or display symptoms of the disease). In some embodiments, "preventing" or "prevention" refers to reducing symptoms of the disease by administering a binding compound provided by the present disclosure in a preventative fashion.

"Solvate" refers to a molecular complex of a compound with one or more solvent molecules in a stoichiometric or non-stoichiometric amount. Such solvent molecules are those commonly used in the pharmaceutical arts, which are known to be innocuous to a patient, e.g., water, ethanol, and the like. A molecular complex of a compound or moiety of a compound and a solvent can be stabilized by non-covalent intra-molecular forces such as, for example, electrostatic forces, van der Waals forces, or hydrogen bonds. The term "hydrate" refers to a solvate in which the one or more solvent molecules is water.

"Therapeutically effective amount" refers to the amount of a compound that, when administered to a patient for treating a disease, or at least one of the clinical symptoms of a disease, is sufficient to treat the disease or symptom thereof. A "therapeutically effective amount" may vary depending, for example, on the compound, the disease and/or symptoms of the disease, severity of the disease and/or symptoms of the disease or disorder, the age, weight, and/or health of the patient to be treated, and the judgment of a prescribing physician. An appropriate amount in any given instance may be ascertained by those skilled in the art or capable of determination by routine experimentation.

"Therapeutically effective dose" refers to a dose that provides effective treatment of a disease or disorder in a patient. A therapeutically effective dose may vary from compound to compound, and from patient to patient, and may depend upon factors such as the condition of the patient and the route of delivery. A therapeutically effective dose may be determined in accordance with routine pharmacological procedures known to those skilled in the art.

"Treating" or "treatment" of a disease refers to arresting or ameliorating a disease or at least one of the clinical symptoms of a disease or disorder, reducing the risk of acquiring a disease or at least one of the clinical symptoms of a disease, reducing the development of a disease or at least one of the clinical symptoms of the disease or reducing the risk of developing a disease or at least one of the clinical symptoms of a disease. "Treating" or "treatment" also refers to inhibiting the disease, either physically, (e.g., stabilization of a discernible symptom), physiologically, (e.g., stabilization of a physical parameter), or both, and to inhibiting at least one physical parameter or manifestation that may or may not be discernible to the patient. In certain embodiments, "treating" or "treatment" refers to delaying the onset of the disease or at least one or more symptoms thereof in a patient who may be exposed to or predisposed to a disease or disorder even though that patient does not yet experience or display symptoms of the disease.

"Tregs" or "Treg cells" refer to regulatory T-cells. Regulatory T-cells are a class of T-cells that suppress the activity of other immune cells and are defined using flow cytometry by the cell marker phenotypes CD4+/CD25+/FOXP3+, CD4+CD25+CD127lo, or CD4+/CD25+/FOXP3+/CD127lo. Because FOXP3 is an intracellular protein and requires cell fixation and permeabilization for staining, the cell surface phenotype CD4+CD25+CD127lo– can be used for defining live Tregs. Tregs also include various Treg subclasses, such as tTregs (thymus-derived) and pTregs (peripherally derived, differentiated from naïve T-cells in the periphery). Tregs play a critical role in the induction and maintenance of peripheral self-tolerance to antigens, including those expressed by tumors.

"CD4+ T cells" are a type of lymphocyte that functions to coordinate the immune response by stimulating other immune cells such as macrophages, B lymphocytes (B cells), CD8 lymphocytes (CD8 cells) to fight infection. CD4+ T cells recognize peptides presented on MHC Class II molecules, which are found on antigen-presenting cells.

As with CD4+ T cells, "CD8+(cytotoxic) T-cells" are generated in the thymus and express the T-cell receptor. Cytotoxic T-cells express a dimeric co-receptor, CD8, which typically comprises one CD8a and one CD80 chain. CD8+ T-cells recognize peptides presented by MHC Class 1 molecules found on most nucleated cells. The CD8 heterodimer binds to a conservative portion of MHC Class 1 during T-cell/antigen presenting cell interactions. CD8+ T-cells (cytotoxic T lymphocytes, or CTLs) are important for immune defense against intracellular pathogens including viruses and bacteria, and for tumor surveillance.

"NK (natural killer) cells" are lymphocytes of the innate immune system and are classified as group I innate lymphocytes (ILCs). NK cells respond to a wide variety of pathological challenges including by killing virally infected cells and detecting and controlling early signs of cancer.

IL-7 mediates a variety of responses in lymphocytes and other immune cells types. Assays for such responses include stimulation of pSTAT5, cell proliferation or markers of proliferation such as Ki67, change in immune cell type ratios, and stimulation of the levels of effector proteins.

"Effector cells" refers to a population of lymphocytes that mediate the helper (CD4+ cells) and cytotoxic (CD8+ and NK cells) effects. Effector cells include effector T-cells such as CD4+ helper T-cells, CD8+ cytotoxic T-cells, NK cells, lymphokine-activated killer (LAK) cells and macrophages/monocytes.

"Naïve T-cells" refer to T-cells that have differentiated in bone marrow and undergone the positive and negative processes of central selection in the thymus. Naïve T-cells include naïve forms of helper T cells, CD4+ T-cells) and naïve cytotoxic T-cells (CD8+ T-cells). Naïve T-cells are commonly characterized by the surface expression of L-selectin (CD62L) and C—C chemokine receptor type 7 (CCR7) and the expression of IL-7R (CD127) and the absence of the activation markers CD25, CD44, and CD69.

"Memory T-cells" area subset of T lymphocytes including both CD4+ and CD8+. The primary function of memory T-cells is rapid augmented immune response after reactivation of those cells by reintroduction of a relevant antigen or pathogen into the body.

"Antigen binding moiety" refers to a polypeptide molecule that specifically binds to an antigenic determinant. An antigen binding moiety can direct, for example, the entity to which it is attached, such as a cytokine or a second antigen binding moiety, to a target site, for example, to a specific type of tumor cell or tumor stroma bearing the antigenic determinant. Antigen binding moieties include antibodies and fragments thereof. Examples of antigen binding moieties include an antigen binding domain of an antibody comprising an antibody heavy chain variable region and an antibody light chain variable region. An antigen binding moiety can include antibody constant regions. Useful heavy chain constant regions can include any of the five isotypes: $\alpha$, $\delta$, $\epsilon$, $y$, or $\mu$. Useful light chain constant regions can include any of the two isotypes K and A.

"Polypeptide" refers to a molecule composed of monomers (amino acids) linearly linked by amide bonds (also known as peptide bonds). The term "polypeptide" refers to any chain of two or more amino acids and does not refer to a specific length of the product. Thus, peptides, dipeptides, tripeptides, oligopeptides, "protein," "amino acid chain," or any other term used to refer to a chain of two or more amino acids, are included within the definition of "polypeptide," and the term "polypeptide" may be used instead of, or interchangeably with any of these terms. The term "polypeptide" is also intended to refer to the products of post-expression modifications of the polypeptide including, for example, glycosylation, acetylation, phosphorylation, amidation, derivatization by known protecting/blocking groups, proteolytic cleavage, and/or modification by non-naturally occurring amino acids. A polypeptide may be derived from a natural biological source or produced by recombinant technology but is not necessarily translated from a designated nucleic acid sequence. A polypeptide may be generated in any manner, including by recombinant methods or by chemical synthesis. A polypeptide may have, for example, more than 100 amino acids, more than 200 amino acids, more than 500 amino acids, more than 1,000 amino acids, or more than 2,000 amino acids. Polypeptides may have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations and are referred to as unfolded.

"Polynucleotide" refers to an isolated nucleic acid molecule or construct, such as messenger RNA (mRNA), virally derived RNA, or plasmid DNA (pDNA). A polynucleotide may comprise a conventional phosphodiester bond or a non-conventional bond, such as an amide bond, such as found in peptide nucleic acids (PNA).

"Nucleic acid molecule" refers to anyone or more nucleic acid segments, such as DNA or RNA fragments, present in a polynucleotide.

"Vector" or "expression vector" is synonymous with "expression construct" and refers to a DNA molecule that is used to introduce and direct the expression of a specific gene to which it is operably associated in a target cell. A vector can be a self-replicating nucleic acid structure as well as a vector incorporated into the genome of a host cell into which it has been introduced. An expression vector can comprise an expression cassette. Expression vectors allow transcription of large amounts of stable mRNA. Once an expression vector is inside the target cell, the ribonucleic acid molecule or protein that is encoded by the gene is produced by the cellular transcription and/or translation machinery. An expression vector can comprise an expression cassette that comprises polynucleotide sequences that encode ligand or binding compound provided by the present disclosure.

"Host cell," "host cell line," and "host cell culture" refer to cells into which are exogenous nucleic acid has been introduced, including the progeny of such cells. Host cells include, for example, "transformants" and "transformed cells," which include the primary transformed cell and progeny derived from the primary transformed cell without regard to the number of passages.

"Antibody" in the broadest sense encompasses various antibody structures including, for example, monoclonal antibodies, polyclonal antibodies, multi-specific antibodies such as bispecific antibodies, and antibody fragments that exhibit a desired antigen binding activity. The term "antibody" can be abbreviated as "ab" such as in the expression Fab or anti-phage Ab.

"Full-length antibody," "intact antibody," and "whole antibody" refer to an antibody having a structure substantially similar to a native antibody structure or having heavy chains that contain both Fab and an Fc region.

"Antibody fragment" refers to a molecule other than an intact antibody that comprises a portion of an intact antibody that binds the antigen to which the intact antibody binds. Examples of antibody fragments include Fv, Fab, Fab', Fab'-SH, F(ab')2, diabodies, linear antibodies, single-chain antibody molecules such as scFv, and multi-specific antibodies formed from antibody fragments. Diabodies are antibody fragments with two antigen binding sites that may be bivalent or bispecific. Antibody fragments can be made by various techniques, including but not limited to proteolytic digestion of an intact antibody as well as production by recombinant host cells such as *E. coli* or phage.

"Fab" or "Fab region" refers to a polypeptide that comprises the VH, CHI, VL, and CL immunoglobulin domains, generally on two different polypeptide chains such as VH-CHI on one chain and VL-CL on the other. Fab may refer to this region in isolation, or this region in the context of a bispecific antibody. In the context of a Fab, the Fab comprises an Fv region in addition to the CHI and CL domains.

"Fv" or "Fv fragment" or "Fv region" refers to a polypeptide that comprises the VL and VH domains of an antibody or "Fab". Fv regions can be formatted as both Fabs (generally two different polypeptides that also include the constant regions) and scFvs, where the vi and vh domains are combined (generally with a linker as discussed) to form an scFv.

"Single chain Fv" or "scFv" refers to a variable heavy domain covalently attached to a variable light domain, generally using a scFv linker as discussed herein, to form a scFv or scFv domain. A scFv domain can be in either orientation with the VL domain at the N- or C-terminus of the polypeptide, and conversely for the VH domain.

"Effector function" refers to a biochemical event that results from the interaction of an antibody Fc region with an Fc receptor or ligand. Effector functions include, for example, antibody-dependent cellular toxicity (ADCC), antibody-dependent cellular phagocytosis (ADCP), and complement-dependent cytotoxicity (CDC).

"Fc" or "Fc region" or "Fc fragment" refers to polypeptide comprising the constant region of an antibody, in some instances, excluding all or a portion of the first constant region immunoglobulin domain (e.g., CHI) or a portion thereof, and in some cases, further excluding all or a portion of the hinge. Thus, an Fc fragment can refer to the last two constant region immunoglobulin domains (e.g., CH2 and CH3) of IgA, IgD, and IgG, the last three constant region immunoglobulin domains of IgE and IgM, and optionally, all or a portion of the flexible hinge N-terminal to these domains. For IgA and IgM, Fc may include the J chain. For IgG, the Fc chain comprises immunoglobulin domains CH2 and CH3 (Cy2 and Cy3), and optionally all or a portion of the hinge region between CHI (Cy1) and CH2 (Cy2). Although the boundaries of the Fc region may vary, the human IgG heavy chain Fc region is usually defined to include residues E216, C226, or A231 to its carboxyl-terminus, wherein the numbering is according to the EU index as in Kabat. An amino acid modification can be made to the Fc region, for example to alter binding to one or more FcyR or to the FcRn. In EU numbering for human IgG1, the CH2-CH3 domain comprises amino acids 231 to 447, and the hinge is 216 to 230. Thus, the definition of Fc chain includes both amino acids 231-447 (CH2-CH3) or 216-447 (hinge-CH2-CH3), or fragments thereof. An Fc fragment can contain fewer amino acids from either or both of the N- and C-termini that retains the ability to form a dimer with another Fc chain or Fc fragment as can be detected using standard methods, generally based on size (e.g., non-denaturing chromatography, size exclusion chromatography, etc.). Human IgG Fc chains are of particular use, and can be the Fc chain from human IgG1, IgG2 or IgG4.

"Heavy constant region" refers to the CH1-hinge-CH2-CH3 portion of an antibody or fragments thereof, excluding the variable heavy domain; in EU numbering of human IgG1, such as amino acids 118-447.

"Heavy chain constant region fragment" refers to a heavy chain constant region that contains fewer amino acids from either or both of the N- and C-termini that retains the ability to form a dimer with another heavy chain constant region.

"Immunoglobulin" refers to a protein having the structure of a naturally occurring antibody. For example, immunoglobulins of the IgG class are heterotetrameric glycoproteins of about 150,000 Da, composed of two light chains and two heavy chains that are bonded together through disulfide bonds. From N- to C-terminus, each heavy chain has a variable region (VH), also called a variable heavy domain or a heavy chain variable domain, followed by three constant domains (CHI, CH2, and CH3), also called a heavy chain constant region. Similarly, from N- to C-terminus, each light chain has a variable region (VL), also called a variable light domain or a light chain variable domain, followed by a constant light (CL) domain, also called a light chain constant region. The heavy chain of an immunoglobulin may be assigned to one of five classes, called α (IgA), δ (IgD), ε (IgE), y (IgG), or μ (IgM), some of which may be further divided into subclasses, such as γ1 (IgG1), γ2 (IgG2), γ3 (IgG3), γ4(gG4), α1 (IgA1) and α2 (IgA2). The light chain of an immunoglobulin may be assigned to one of two types, kappa (κ) or lambda (λ), based on the amino acid sequence of its constant domain. An immunoglobulin essentially consists of two Fab molecules and an Fc chain, linked via the immunoglobulin hinge region.

"Immunoconjugate" refers to a polypeptide molecule that includes at least one ligand provided by the present disclosure and at least one antigen binding moiety. An immunoconjugate can comprise at least one ligand, and at least two antigen binding moieties. An immunoconjugate can comprise at least one ligand and two antigen binding moieties joined by one or more linker sequences. An antigen binding moiety can be joined to the ligand by a variety of interactions and in a variety of configurations.

"Linker" refers to a moiety that binds one compound to another compound. Linkers can include ligand linkers, and ligand construct linkers. A linker can be a synthetic linker. A linker can be an amino acid linker. In general, linkers provided by the present disclosure facilitate the ability of a ligand to interact with IL-2R and/or IL-7R, to bind to IL-2R and/or IL-7R with an $IC_{50}$ less than 100 μM, and/or to activate IL-2R and/or IL-7R, either fully or partially. A linker can comprise a peptide or a non-peptide. Non-peptide linkers include those containing, for example, a triazole moiety derived from a Cu(I) catalyzed reaction of alkyne and azide functionalities. Non-peptide linkers can be referred to as synthetic chemical linkers. A ligand linker refers to a moiety that binds at least one ligand such as an Il-2Rβ ligand, an IL-7Rα ligand and/or an Ryc ligand to another Il-2Rβ ligand, IL-7Rα ligand and/or Ryc ligand. A linker can bind to another ligand which can be the same ligand or can be a different ligand. A linker can also bind to one or more additional moieties that provide a desired physiological function. For example, a construct linker can bind a ligand to a construct partner. A linker can be divalent or multivalent. A linker can be hydrolytically stable or may include a physiologically hydrolyzable or enzymatically degradable or cleavable linkage. A linker can bind ligands to form dimers, trimers, or higher order multi-ligand peptides (heteromers) and compounds.

A "flexible linker" refers to a peptidyl linker comprising flexible amino acids such as glycine and serine. A flexible linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from glycine and serine. Examples of flexible linkers include $(G)_n$ (SEQ ID NO: 9380), $(GS)_n$ (SEQ ID NO: 9381), $(GGS)_n$ (SEQ ID NO: 9382), $(GGGS)_n$ (SEQ ID NO: 9383), or $(GGGGS)_n$ (SEQ ID NO: 9384) where n can be an integer from 1 to 20; $(G)_n$ (SEQ ID NO: 9385), $(GS)_n$ (SEQ ID NO: 9386), $(GGS)_n$ (SEQ ID NO: 9387), $(GGGS)_n$ (SEQ ID NO: 9388), or $(GGGGS)_n$ (SEQ ID NO: 9389) where n can be an integer from 1 to 10; or $(G)_n$ (SEQ ID NO: 9390), $(GS)_n$ (SEQ ID NO: 9391), $(GGS)_n$ (SEQ ID NO: 9392), $(GGGS)_n$ (SEQ ID NO: 9393), or $(GGGGS)_n$ (SEQ ID NO: 9394) where n can be an integer from 1 to 5. (A flexible linker can have the amino acid sequence, for example, $(GGGGS)_n$ (SEQ ID NO: 9395), (GGGGS)2 (SEQ ID NO: 9396), (GGGGS)3 (SEQ ID NO: 9397), (GGGGS)4 (SEQ ID NO: 9398), (GG) (SEQ ID NO: 9399), (GGG) (SEQ ID NO: 9400), (GGGGG) (SEQ ID NO: 9401), (GGS) (SEQ ID NO: 9402), (GGGS) (SEQ ID NO: 9403), (GGGGSGG) (SEQ ID NO: 9404), (GGS)2 (SEQ ID NO: 9405), $(G)5$ (SEQ ID NO: 9406), or (GS)10 (SEQ ID NO: 9407).

A "rigid linker" refers to a peptidyl linker that is proline rich and can include other amino acids such as alanine, lysine, and/or glutamic acid. A rigid linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from proline, alanine, lysine, and glutamic acid. A rigid linker can comprise, for example, from 1 to 100 amino acids such as from 1 to 50, from 1 to 40, from 1 to 30, from 1 to 20, from 1 to 10, or from 1 to 5 amino acids, where each amino acid is independently selected from proline and alanine. A rigid linker can have the sequence $(P)_n$ (SEQ ID NO: 9420) or $(PA)_n$ (SEQ ID NO: 9421), where n is an integer from 1 to 20. A rigid linker can have the sequence $(P)_n$ (SEQ ID NO: 9422) or $(PA)_n$ (SEQ ID NO: 9423), where n is an integer from 1 to 10. A rigid linker can have the sequence $(P)_n$ (SEQ ID NO: 9424) or $(PA)_n$ (SEQ ID NO: 9425), where n is an integer from 1 to 5. A rigid linker can have the sequence $(PA)_5$ (SEQ ID NO: 9426), $(PA)_7$ (SEQ ID NO: 9427), or $(PA)_{10}$ (SEQ ID NO: 9428).

"Protein" refers to at least two covalently attached amino acids, which includes proteins, polypeptides, oligopeptides and peptides. In addition, polypeptides that make up the antibodies may include synthetic derivatization of one or more side chains or termini, glycosylation, PEGylation, circular permutation, cyclization, linkers to other molecules, fusion to proteins or protein domains, and addition of peptide tags or labels. When a biologically functional molecule comprises two or more proteins, each protein may be referred to as a "monomer" or as a "subunit" or as a "domain"; and the biologically functional molecule may be referred to as a "complex".

"Amino acid sequence similarity" refers to an amino acid sequence in which one or more amino acids of the sequence has been replaced with a chemically similar amino acid. Examples of chemically similar amino acids include (a) amino acids having a small hydrophobic side chain such as alanine (A), glycine (G), proline (P), serine (S), or threonine (T); (b) amino acids having a hydroxyl-containing side chain such as serine (S), threonine (T), or tyrosine (Y); (c) amino acids having an acidic side chain such as aspartate (D) or glutamate (E); (d) amino acids having a polar-neutral side chain such as histidine (H), asparagine (N), glutamine (Q), serine (S), threonine (T), or tyrosine (Y); (e) amino acids having a basic side chain such as arginine (R), lysine (K), or histidine (H); (f) amino acids having a large hydrophobic side chain such as isoleucine (I), leucine (L), methionine (M), valine (V), phenylalanine (F), tyrosine (Y), or tryptophan (W); and (g) amino acids having an aromatic side chain comprising phenylalanine (F), histidine (H), tryptophan (W), or tyrosine (Y). A chemically similar amino acid can comprise a naturally occurring amino acid or a non-natural amino acid.

"Percent (%) sequence similarity" is determined by comparing the number of amino acids that are the same in a subject ligand and a reference ligand. A ligand provided by the present disclosure can comprise, for example, greater than 70%, greater than 80%, or greater than 90% sequence similarity to a reference ligand. For example, based on a reference ligand having SEQ ID NO: 9001, ligands having SEQ ID NOS: 9002-9007, have either 1, 2, 3, 4, or 5 amino acid in which an amino acid of the reference ligand has been substituted or replaced with the amino acid, alanine. Ligands having SEQ ID NOS: 9002-9007 are characterized by a 95%, 90%, 85%, 80%, 75%, or 70% sequence similarity, respectively, to the reference ligand.

```
                                      SEQ ID NO: 9001
Y P C W L A R V G E L C D L D S G D V H

SEQ ID NO: 9002
A P C W L A R V G E L C D L D S G D V H

SEQ ID NO: 9003
A P C A L A R V G E L C D L D S G D V H

SEQ ID NO: 9004
A P C A L A A V G E L C D L D S G D V H

SEQ ID NO: 9005
A P C A L A A V G A L C D L D S G D V H

SEQ ID NO: 9006
A P C A L A A V G A L C D L A S G D V H

SEQ ID NO: 9007
A P C A L A A V G A L C D L A A G D V H
```

A ligand provided by the present disclosure such as an IL-2Rβ ligand, an IL-7Rα ligand, an Rγc ligand, an IL-2Rβγc ligand, an IL-7Rαγc ligand, or a dual receptor binding ligand can have an amino acid sequence in which, for example, from 1 to 10 amino acids or from 1 to 5 amino acids of a reference amino acid sequence is substituted with another amino acid.

For example, a binding compound derived from a reference binding compound can have from 1 to 5 amino acid substitutions, from 1 to 4, from 1 to 3, or from 1 to 2 amino acid substitutions. For example, a binding compound derived from a reference binding compound can have 1 amino acid substitution, 2 amino acid substitutions, 3 amino acid substitutions, 4 amino acid substitutions, or 5 amino acid substitutions.

An amino acid substitution can be independent of other amino acid substitutions.

Each amino acid substitution can independently be a conservative amino acid substitution or a non-conservative amino acid substitution.

A conservative amino acid substitution refers to one of the following amino acid substitutions: amino acids having a small hydrophobic side chain comprising alanine (A), glycine (G), proline (P), serine (S), or threonine (T); amino acids having a hydroxyl-containing side chain comprising serine (S), threonine (T), or tyrosine (Y); amino acids having an acidic side chain comprising aspartate (D) or glutamate (E); amino acids having a polar-neutral side chain comprising histidine (H), asparagine (N), glutamine (Q), serine (S), threonine (T), or tyrosine (Y); amino acids having a basic side chain comprising arginine (R), lysine (K), or histidine (H); amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

For example, a reference ligand can have the amino acid sequence of SEQ ID NO: 9011. Ligands having SEQ ID NOS: 9012-9016 represent substituted ligands in which the reference ligand having SEQ ID NO: 9011 has been substituted with from 1 to 5 conservative amino acid substitutions, respectively.

```
                                   SEQ ID NO: 9011
Y W C W M A Q V G E L C D L

SEQ ID NO: 9012
Y H C W M A Q V G E L C D L

SEQ ID NO: 9013
Y H C W M G Q V G E L C D L

SEQ ID NO: 9014
Y H C W M G Q M G E L C D L

SEQ ID NO: 9015
Y H C W M G Q M G E L C E L

SEQ ID NO: 9016
Y H C W M G Q M G E L C E M
```

A ligand provided by the present disclosure can comprise a truncated ligand. A truncated ligand refers to a ligand in which, for example, from 1 to 10 or from 1 to 5 amino acids have independently been removed from the N-terminus, the C-terminus, or from both the N-terminus and the C-terminus of the corresponding reference ligand. A truncated ligand derived from the corresponding reference ligand can independently have from 1 to 5 amino acids, such as from 1 to 4 amino acids, from 1 to 3 amino acids, or from 1 to 2 amino acids independently removed from the N-terminus, the C-terminus, or from both the N-terminus and the C-terminus of the reference ligand. A truncated ligand derived from the corresponding ligand can independently have 1 amino acid, 2 amino acids, 3 amino acids, 4 amino acids, or 5 amino acids removed from the N-terminus, the C-terminus, or from both the N-terminus and the C-terminus of the reference ligand.

For example, a reference ligand can have the amino acid sequence of SEQ ID NO: 9021. Examples of truncated ligands derived from the reference ligand having SEQ ID NO: 9021 include truncated ligands having an amino acid sequence of SEQ ID NOS: 9022-9029.

```
                                   SEQ ID NO: 9021
M G F Y P C W T A Q L G E L C D L S V D

SEQ ID NO: 9022
  G F Y P C W T A Q L G E L C D L S V D

SEQ ID NO: 9023
    F Y P C W T A Q L G E L C D L S V D

SEQ ID NO: 9024
      Y P C W T A Q L G E L C D L S V D

SEQ ID NO: 9025
M G F Y P C W T A Q L G E L C D L S V

SEQ ID NO: 9026
M G F Y P C W T A Q L G E L C D L S

SEQ ID NO: 9027
M G F Y P C W T A Q L G E L C D L

SEQ ID NO: 9028
  G F Y P C W T A Q L G E L C D L S V

SEQ ID NO: 9029
    F Y P C W T A Q L G E L C D L
```

The truncated ligands of SEQ ID NOS: 9022-9024 have from 1 to 3 amino acids removed from the N-terminus of the reference ligand, respectively; truncated binding compounds ligands having SEQ ID NOS: 9025 to 9027 have from 1 to 3 amino acids removed from the C-terminus of the reference ligand, respectively; and truncated ligands having SEQ ID NOS: 9028 and 9029 have amino acids removed from both the N-terminus and from the C-terminus of the reference ligand.

As another example of truncated ligands, a reference ligand can comprise an amino acid sequence of Formula (A):

$$-X^{500}-X^{501}-C-X^{502}-X^{503}-X^{504}-X^{505}-X^{506}-X^{507}-X^{508}-X^{509}-C-X^{510}-X^{511}- \quad (A)$$

where each -X- independently represents an amino acid. Amino acid sequences of Formula (A1)-(A5) represent examples of truncated ligands derived from the reference ligand comprising the amino acid sequence of Formula (A):

$$-X^{1}-C-X^{2}-X^{3}-X^{4}-X^{5}-X^{6}-X^{7}-X^{8}-X^{9}-C-X^{10}-X^{11}- \quad (A1)$$

$$-C-X^{2}-X^{3}-X^{4}-X^{5}-X^{6}-X^{7}-X^{8}-X^{9}-C-X^{10}-X^{11}- \quad (A2)$$

$$-C-X^{2}-X^{3}-X^{4}-X^{5}-X^{6}-X^{7}-X^{8}-X^{9}-C- \quad (A3)$$

$$-X^{2}-X^{3}-X^{4}-X^{5}-X^{6}-X^{7}-X^{8}-X^{9}-C-X^{10}- \quad (A4)$$

$$-X^{2}-X^{3}-X^{4}-X^{5}-X^{6}-X^{7}-X^{8}-X^{9}- \quad (A5)$$

A ligand provided by the present disclosure can comprise an amino acid sequence in which from 1 to 3 flanking amino acids such as glycines are independently bonded to the N-terminus, to the C-terminus, or to both the N-terminus and to the C-terminus of a reference ligand.

For example, a reference ligand can have SEQ ID NO: 9031. Ligands having SEQ ID NOS: 9032-9034 have from 1 to 3 glycines bonded to the N-terminus of the reference ligand, respectively; ligands having SEQ ID NOS: 9035-9037 have from 1 to 3 glycines bonded to the C-terminus of the reference ligand, respectively; and ligands having SEQ ID NOS: 9038 and 9039 have one (1) or two (2) glycines bonded to both the N-terminus and to the C-terminus of the reference ligand.

```
                                          SEQ ID NO: 9031
    K Y C G F A Q L G E L C V L

SEQ ID NO: 9032
  G K Y C G F A Q L G E L C V L

SEQ ID NO: 9033
G G K Y C G F A Q L G E L C V L

SEQ ID NO: 9034
G G G K Y C G F A Q L G E L C V L

SEQ ID NO: 9035
    K Y C G F A Q L G E L C V L G

SEQ ID NO: 9036
    K Y C G F A Q L G E L C V L G G

SEQ ID NO: 9037
    K Y C G F A Q L G E L C V L G G G

SEQ ID NO: 9038
  G K Y C G F A Q L G E L C V L G

SEQ ID NO: 9039
G G K Y C G F A Q L G E L C V L G
```

A ligand provided by the present disclosure can comprise one or more flanking amino acids such as, for example, flanking glycine groups on the N-terminus and/or the C-terminus of the respective ligand. For example, a ligand can comprise one or more flanking amino acids such as $(G)_n$ glycines (SEQ ID NO: 9385) where n can be an integer from 1 to 10, from 1 to 8, from 2 to 6, from 2 to 4, or from 2 to 3.

"IL-2R", "IL-2Rβ subunit", "IL-7R", "IL-7Rα subunit", and "Rγc subunit" refer to a mammalian "IL-2R", "IL-2Rβ subunit", "IL-7R", "IL-7Rα subunit", and "Rγc subunit" respectively, such as human IL-2R, the human IL-2Rβ subunit, human IL-7R, the human IL-7Rα subunit, and the Rγc subunit, respectively.

A recombinant "ligand fusion protein" refers to a protein made by recombinant DNA technology in which the translational reading frame of a ligand is fused to that of another protein, i.e., the ligand fusion partner, to produce a single recombinant polypeptide. A ligand fusion protein can comprise one or more ligands provided by the present disclosure. A ligand-fusion partner can comprise the Fc domain of an IgG molecule where the ligand is attached to one or both C-termini of the Fc structures. A ligand-fusion protein can include a peptidyl linker such as an amino acid sequence coupling the ligand to the fusion protein partner, such that the peptidyl linker amino acid sequence is not derived from either the ligand or the fusion protein partner. Such linkers are referred to as construct linkers. Construct linkers can be incorporated into fusion proteins as spacers to promote proper protein folding and stability of the component protein moieties, to improve protein expression, and/or to enable better bioactivity of the two fusion partners. Construct linkers can include, for example, flexible peptides and/or rigid peptides. A construct linker can be a chemical construct linker.

The expression "at least one" refers to "one or more." For example, the expression "at least one" can refer to from 1 to 10, from 1 to 8, from 1 to 6, from 1 to 5, from 1 to 4, from 1 to 3, or from 1 to 2. For example, the expression "at least one" can refer to 1, 2, 3, 4, 5, 6, 7, 8, 9, or 10.

Reference is now made in detail to certain embodiments of ligands, ligand binding compounds, compositions, methods of synthesis and methods of use. The disclosed embodiments are not intended to be limiting of the claims. To the contrary, the claims are intended to cover all alternatives, modifications, and equivalents.

The present disclosure is directed to dual IL-2R and IL-7R binding compounds. A dual receptor binding compound can comprise (1) an IL-2Rβ ligand, an IL-7Rα ligand, and an Rγc ligand, and/or (2) an IL-2Rβγc ligand and an IL-7Rαγc ligand. A dual receptor binding compound provided by the present disclosure is capable of binding to both IL-2R and IL-7R with an $IC_{50}$ of less than 100 µM, such as less than 10 µM, less than 1 µM, or less than 0.1 µM.

A dual receptor binding compound provided by the present disclosure can comprise a dual IL-2R/IL-7R ligand comprising an IL-2Rβ ligand, an IL-7Rα ligand, and an Rγc ligand. A dual IL-2R/IL-7R ligand can be linear or branched. A dual IL-2R/IL-7R ligand can be bound to a construct partner such as a PEG or an Fc-fragment.

A dual receptor binding compound provided by the present disclosure can comprise a dual IL-2R/IL-7R binding construct comprising at least one IL-2Rβγc ligand and at least one IL-7Rαγc ligand bound to another molecule. For example, a dual IL-2R/IL-7R binding construct can be a heterodimer Fc-fragment in which an IL-2Rβγc ligand is bound to one CH3 domain and an IL-7Rαγc ligand is bound to the other CH3 domain. As another example, a dual IL-2R/IL-7R binding construct can comprise a dual IL-2R/IL-7R ligand bound to one or both of the CH3 domains of an Fc-fragment.

A dual IL-2R/IL-7R binding compound provided by the present disclosure can be, for example, a full IL-2R agonist and a full IL-7R agonist, a full IL-2R agonist and a partial IL-7R agonist, a partial IL-2R agonist and a full IL-7R agonist, a partial IL-2R agonist and a partial IL-7R agonist, or an IL-2R agonist and an IL-7R agonist.

An IL-2Rβγc ligand can have the structure of Formula (101):

$$\text{-B-L-G-} \qquad (101)$$

where,
B can comprise an IL-2Rβ ligand;
G can comprise an Rγc ligand; and
L can be a ligand linker.

In an IL-2Rβγc ligand of Formula (101), the C-terminus of the IL-2Rβ ligand can be bound to the ligand linker, or the N-terminus of the IL-2Rβ ligand can be bound to the ligand linker.

In an IL-2Rβγc ligand of Formula (101), the C-terminus of the Rγc ligand can be bound to the ligand linker, or the N-terminus of the Rγc ligand can be bound to the ligand linker.

In an IL-2Rβγc ligand of Formula (101), the C-terminus or the N-terminus of IL-2Rβ ligand and the Rγc ligand can independently be bound to the ligand linker.

In an IL-2Rβγc ligand of Formula (101), the IL-2Rβ ligand can comprise two cysteines and the two cysteines can be bonded together through a disulfide bond; and the Rγc ligand can comprise two cysteines and the two cysteines can be bonded together through a disulfide bond; and/or the IL-2Rβ ligand can comprise a cysteine and the Rγc ligand can comprise a cysteine, where the two cysteines are bonded together through a disulfide bond.

An IL-7Rαγc ligand has the structure of Formula (102):

-A-L-G- (102)

where,
A can comprise an IL-7Rα ligand;
G can comprise an Rγc ligand; and
L can be a ligand linker.

In an IL-7Rαγc ligand of Formula (102), the C-terminus of the IL-7Rα ligand can be bound to the ligand linker, or the N-terminus of the IL-7Rα ligand is bound to the ligand linker.

In an IL-7Rαγc ligand of Formula (102), the C-terminus of the Rγc ligand can be bound to the ligand linker, or the N-terminus of the Rγc ligand can be bound to the ligand linker.

In an IL-7Rαγc ligand of Formula (102), the C-terminus or the N-terminus of IL-7Rα ligand and the Rγc ligand can independently be bound to the ligand linker.

In an IL-7Rαγc ligand of Formula (102), the IL-7Rα ligand can comprise two cysteines and the two cysteines can be bonded together through a disulfide bond; and the Rγc ligand can comprise two cysteines and the two cysteines can be bonded together through a disulfide bond; and/or the IL-7Rα ligand can comprise a cysteine and the Rγc ligand can comprise a cysteine, where the two cysteines are bonded together through a disulfide bond.

Ligands provided by the present disclosure can comprise disulfide bonds. For example, IL-2Rβ ligands, IL-7Rα ligands and Rγc ligands can comprise at least two cysteines. The at least two cysteines of each ligand can be bound to another cysteine of the same ligand through a disulfide bond or one or more cysteines of one ligand can be bound to one or more cysteines of another ligand through a disulfide bond.

For example, in an IL-2Rβγc ligand, two cysteines of the IL-2Rβ ligand can be bound together through a disulfide bond and/or two cysteines of the Rγc ligand can be bound together through a disulfide bond. In an IL-2Rβγc ligand a cysteine of the IL-2Rβ ligand can be bound to a cysteine of the Rγc ligand through a disulfide bond, or each of the two cysteines of the IL-2Rβ ligand can be bound to a cysteine of the Rγc ligand. For example, in a dual ligand or portion of a linear dual ligand having the structure of Formula (103):

-X-$C^1$-X-$C^2$-X-L-Y-$C^3$-Y-$C^4$-Y- (103)

where -X-$C^1$-X-$C^2$-X- represents an amino acid sequence of a first ligand having two cysteines, $C^1$ and $C^2$, and where each X is independently one or more amino acids; -Y-$C^3$-Y-$C^4$-Y- represents an amino acid sequence of a second ligand having two cysteines, $C^3$ and $C^4$, and where each Y is independently one or more amino acids, and -L- is ligand linker coupling the first ligand and the second ligand. The first and second ligands can independently be selected from an IL-2Rβγc ligand, an IL-7Rα ligand, and an Rγc ligand.

In a ligand of Formula (103), $C^1$ can be bound to $C^2$ and $C^3$ can be bound to $C^4$ through disulfide bonds; $C^1$ can be bound to $C^3$ and $C^2$ can be bound to $C^4$ through disulfide bonds, or $C^1$ can be bound to $C^4$ and $C^2$ can be bound to $C^3$ through disulfide bonds.

IL-2Rβγc ligands and IL-7Rαγc ligands that contain more than two cysteines can have a preferred pattern of Cys-Cys bonds (disulfide bridges) that exhibit the greatest activity such as, for example, Cys 1-2, and Cys 3-4, and other disulfide patterns can exhibit desired activity and have useful properties.

IL-2Rβγc ligands provided by the present disclosure can comprise an IL-2Rβ ligand, an Rγc ligand, and an IL-2Rβγc ligand linker coupling the IL-2Rβ and Rγc ligands. An IL-2Rβγc ligand can be an IL-2R agonist, a partial IL-2R agonist, or an IL-2R antagonist.

An IL-2Rβγc ligand can comprise at least one IL-2Rβ ligand and at least one Rγc ligand.

Examples of suitable IL-2Rβ ligands are disclosed in U.S. Application Publication No. 2020/0040034, which is incorporated by reference in its entirety.

Examples of suitable Rγc ligands are disclosed in U.S. Application Publication No. 2020/0040036, which is incorporated by reference in its entirety.

Tandem IL-2Rβγc ligands provided by the present disclosure comprise two or more IL-2Rβγc ligands coupled together by one or more tandem linkers.

Dual receptor binding compounds provided by the present disclosure can comprise at least one IL-2Rβγc ligand coupled to another molecule referred to as a construct partner such as a polymer, protein, Fc-fragment, immunoglobulin fragment, or antibody. A dual receptor binding compound provided by the present disclosure can also comprise at least one IL-2Rβ ligand and at least one Rγc ligand.

A dual receptor binding compound provided by the present disclosure include compounds capable of binding to a specific binding site on the IL-2Rβ subunit and/or the Rγc subunit of IL-2R and can bind to the specific binding site with an $IC_{50}$ of less than 100 μM, less than 10 μM, less than 1 μM, less than 100 nM, or less than 10 nM.

An IL-2Rβγc ligand provided by the present disclosure can bind to IL-2R such as human IL-2R with an $IC_{50}$ from 1 pM to 100 μM, from 10 pM to 10 μM, from 100 pM to 1 μM, from 0.001 μM to 1 μM, or from 0.01 μM to 1 μM.

An IL-2Rβγc ligand provided by the present disclosure can bind to IL-2R such as human IL-2R with an $IC_{50}$ of less than 100 μM, less than 10 μm, less than 1 μm, less than 100 μM, less than 10 μM, or less than 1 pM.

An IL-2Rβγc ligand provided by the present disclosure can bind to each of the IL-2Rβ subunit and to the Rγc subunit of IL-2R, such as each of the human IL-2Rβ subunit and the human Rγc subunit of IL-2R, with an $IC_{50}$ from 1 pM to 100 μM, from 10 pM to 10 μM, from 100 pM to 1 μM, from 0.001 μM to 1 μM, or from 0.01 μM to 1 μM.

An IL-2Rβγc ligand provided by the present disclosure can bind to each of the IL-2Rβ subunit and the Rγc subunit of IL-2R, such as each of the human IL-2Rβ subunit and to the human Rγc subunit of IL-2R with an $IC_{50}$ of less than 100 μM, less than 10 μM, less than 1 μM, less than 100 pM, less than 10 pM, or less than 1 pM.

An IL-2Rβγc ligand provided by the present disclosure can exhibit an $EC_{50}$ for STAT5 phosphorylation in TF-1-β cells, for example, of less than 100 μM, less than 10 μM, less than 1 μM, less than 100 pM, less than 10 pM, or less than 1 pM. An IL-2Rβγc ligand provided by the present disclosure can exhibit an $EC_{50}$ for STAT5 phosphorylation in TF-1β cells, for example, from 1 pM to 100 μM, from 10 pM to 10 μM, from 100 pM to 1 μM, from 0.001 μM to 1 μM, or from 0.01 μM to 1 μM.

IL-7Rαγc ligands provided by the present disclosure comprise an IL-7Rα ligand, an Rγc ligand, and an IL-7Rαγc ligand linker coupling the IL-7Rα and Rγc ligands. An IL-7Rαγc ligand can be an IL-7R agonist, a partial IL-7R agonist, or an IL-7R antagonist.

An IL-7Rαγc ligand can comprise at least one IL-7Rα ligand and at least one Rγc ligand.

Examples of suitable Rγc ligands are disclosed in U.S. Application Publication No. 2020/0040036, which is incorporated by reference in its entirety.

Tandem IL-7Rαγc ligands provided by the present disclosure comprise two or more IL-7Rαγc ligands coupled together by one or more tandem linkers.

Dual receptor binding compounds provided by the present disclosure can comprise at least one IL-7Rαγc ligand coupled to another molecule referred to as a construct partner such as a polymer, protein, Fc-fragment, immunoglobulin fragment, or antibody. A dual receptor binding compound provided by the present disclosure can also comprise at least one IL-7Rα ligand and at least one Rγc ligand.

Dual receptor binding compounds provided by the present disclosure include compounds capable of binding to a specific binding site on the IL-7Rα subunit and/or the Rγc subunit of IL-7R and can bind to the specific binding site with an $IC_{50}$ of less than 100 μM, less than 10 μM, less than 1 μM, less than 100 nM, or less than 10 nM.

An IL-7Rαγc ligand provided by the present disclosure can bind to IL-7R such as human IL-7R with an $IC_{50}$ from 1 pM to 100 μM, from 10 pM to 10 μM, from 100 pM to 1 μM, from 0.001 μM to 1 μM, or from 0.01 μM to 1 μM.

An IL-7Rαγc ligand provided by the present disclosure can bind to IL-7R such as human IL-7R with an $IC_{50}$ of less than 100 μM, less than 10 μM, less than 1 μM, less than 100 μM, less than 10 pM, or less than 1 pM.

An IL-7Rαγc ligand provided by the present disclosure can bind to each of the IL-7Rα subunit and to the Rγc subunit of IL-7R, such as each of the human IL-7Rα subunit and the human Rγc subunit of IL-7R, with an $IC_{50}$ from 1 pM to 100 μM, from 10 pM to 10 μM, from 100 pM to 1 μM, from 0.001 μM to 1 μM, or from 0.01 μM to 1 μM.

An IL-7Rαγc ligand provided by the present disclosure can bind to each of the IL-7Rα subunit and the Rγc subunit of IL-7R, such as each of the human IL-7Rα subunit and to the human Rγc subunit with an $IC_{50}$ of less than 100 μM, less than 10 μM, less than 1 μM, less than 100 pM, less than 10 pM, or less than 1 pM.

An IL-7Rαγc ligand provided by the present disclosure can exhibit an $EC_{50}$ for STAT5 phosphorylation in TF-1-β cells, for example, of less than 100 μM, less than 10 μM, less than 1 μM, less than 100 pM, less than 10 pM, or less than 1 pM.

An IL-7Rαγc ligand provided by the present disclosure can exhibit an $EC_{50}$ for STAT5 phosphorylation in TF-1β cells, for example, from 1 pM to 100 μM, from 10 pM to 10 μM, from 100 pM to 1 μM, from 0.001 μM to 1 μM, or from 0.01 μM to 1 μM.

A dual receptor binding ligand provided by the present disclosure can comprise at least one IL-2Rβ ligand, at least one IL-7Rα ligand, and at least one Rγc ligand.

A dual receptor binding ligand can comprise a linear dual receptor binding ligand or a branched dual receptor binding ligand.

A linear dual receptor binding ligand provided by the present disclosure can have the structure of any one of Formula (104a)-(104f):

  (104a)

  (104b)

  (104c)

  (104d)

  (104e)

  (104f)

where,

A can be an IL-7Rα ligand;

B can be an IL-2Rβ ligand;

G can be an Rγc ligand; and each of $L^1$ and $L^2$ can independently be a ligand linker.

In a linear dual receptor binding ligand of Formula (104a)-(104f), each of the IL-2Rβ ligand, the IL-7Rα ligand, and the Rγc ligand can independently be in the N/C-orientation or in the C/N-orientation.

In a linear dual receptor binding ligand of Formula (104a)-(104f) each of the IL-2Rβ ligand, the IL-7Rα ligand and the Rγc ligand can have two cysteines. Each of the two cysteines of the IL-2Rβ ligand, the IL-7Rα ligand and the Rγc ligand can independently be bound to each other by a disulfide bond or may not be bound to another cysteine. In a linear dual receptor binding ligand of Formula (104a)-(104f) a cysteine of one ligand can be bound to a cysteine of another ligand through a disulfide bond.

A branched dual receptor binding ligand provided by the present disclosure can have the structure of any one of Formula (105a)-(105d):

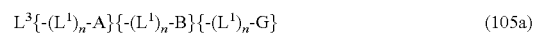  (105a)

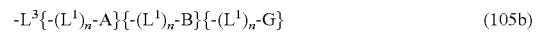  (105b)

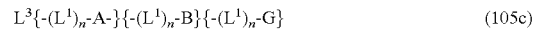  (105c)

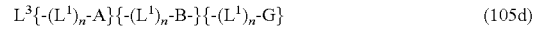  (105d)

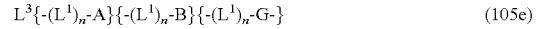  (105e)

where, n can be 0 or 1;

A can be an IL-7Rα ligand;

B can be an IL-2Rβ ligand;

G can be an Rγc ligand;

each $L^1$ can independently be a ligand linker; and $L^3$ can be a trifunctional core.

In a branched dual receptor binding ligand of Formula (105a)-(105e), each of the IL-2Rβ ligand, the IL-7Rα ligand, and the Rγc ligand can be independently bonded to the trifunctional core in the N/C-orientation or in the C/N-orientation.

In a branched dual receptor binding ligand of Formula (105a)-(105e), the IL-2Rβ ligand can comprise two cysteines and the two cysteines can be bonded together through a disulfide bond; the IL-7Rα ligand can comprise two cysteines, and/or the two cysteines can be bonded together through a disulfide bond; and/or the Rγc ligand can comprise two cysteines and the two cysteines can be bonded together through a disulfide bond.

A branched dual receptor binding ligand can be bonded to another moiety, for example, through the trimeric core (Formula (105b)), through the IL-7Rα ligand (Formula (105c)), through the IL-2Rβ ligand (Formula (105d)), or through the Rγc ligand (Formula (105e)).

A branched dual receptor binding ligand provided by the present disclosure can have the structure of any one of Formula (106a)-(106b):

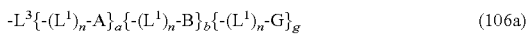 (106a)

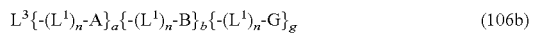 (106b)

where, n is 0 or 1;

each of a, b, and g is independently an integer from 1 to 3;

A is an IL-7Rα ligand;

B is an IL-2Rβ ligand;

G is an Rγc ligand;

each $L^1$ is independently a branched ligand linker; and $L^3$ is a polyfunctional core.

In branched dual receptor binding ligands of Formula (106a)-(106b), each of the IL-2Rβ ligand, the IL-7Rα ligand, and the Rγc ligand can independently be bonded to the trimeric core in the N/C-orientation or in the C/N-orientation.

In branched dual receptor binding ligands of Formula (106a)-(106b), the IL-2Rβ ligand can comprise two cysteines and the two cysteines can be bonded together through a disulfide bond; the IL-7Rα ligand can comprise two cysteines and the two cysteines can be bonded together through a disulfide bond; and/or the Rγc ligand can comprise two cysteines and the two cysteines can be bonded together through a disulfide bond.

In a branched dual receptor binding ligand, each of the IL-2Rβ ligand, the IL-7Rα ligand, and the Rγc ligand can independently be covalently bound to the branched ligand core, either directly or through a branched ligand linker, through the N-terminus or through the C-terminus of the respective ligand.

For example, the N-terminus of each of the IL-2Rβ ligand, the IL-7Rα ligand, and the Rγc ligand can be covalently bound to the branched ligand linker, the C-terminus of each of the IL-2Rβ ligand, IL-7Rα ligand, and Rγc ligand can be covalently bound to the branched ligand linker; the N-terminus of the IL-7Rα ligand, the N- or C-terminus of the IL-2Rβ ligand, and the N- or C-terminus of the Rγc ligand can be covalently bound to the branched ligand linker; or the C-terminus of the IL-7Rα ligand, the N- or C-terminus of the IL-2Rβ ligand, and the N- or C-terminus of the Rγc ligand can be covalently bound to the branched ligand linker.

A polyfunctional core of a branched polyfunctional ligand can have a functionality equivalent to the sum of the number of IL-2Rβ ligands, IL-7Rα ligands, and Rγc ligands bonded to the branched ligand core. For example, a branched polyfunctional ligand can have a functionality of 3, 4, 5, 6, 7, 8 or 9 and can comprise at least one IL-2Rβ ligand, at least one IL-7Rα ligand, and at least one Rγc ligand.

A core of a branched ligand can comprise amino acids, non-amino acids, or a combination thereof.

A core of a branched ligand can comprise three or more arms such as from 3 to 6 arms configured to bind to an IL-2Rβ ligand, an IL-7Rα ligands, and an Rγc ligand.

The arms can extend from a common atom such as a carbon atom, from a common moiety such as a cyclic moiety or can extend from a common backbone such as a linear or branched backbone.

A core of a branched ligand can be configured to facilitate binding of the IL-2Rβ ligand, the IL-7Rα ligand, and the Rγc ligand to the respective binding sites of IL-2R and IL-7R. For example, a core of a branched ligand can be configured to facilitate binding of the IL-2Rβ ligand, the IL-7Rα ligand, and the Rγc ligand to the IL-2Rβ subunit, the IL-7Rα subunit, and to the Rγc subunit of IL-2R and/or IL-7R, respectively. For example, a core of a branched ligand can be configured to facilitate activation of IL-2R and IL-7R by the branched dual receptor binding ligand. For example, a core of a branched ligand can be configured to induce IL-2R- and IL-7R-mediated STAT5 phosphorylation in TF-1-7α cells.

A core of a branched ligand can have, for example, one of the following structures:

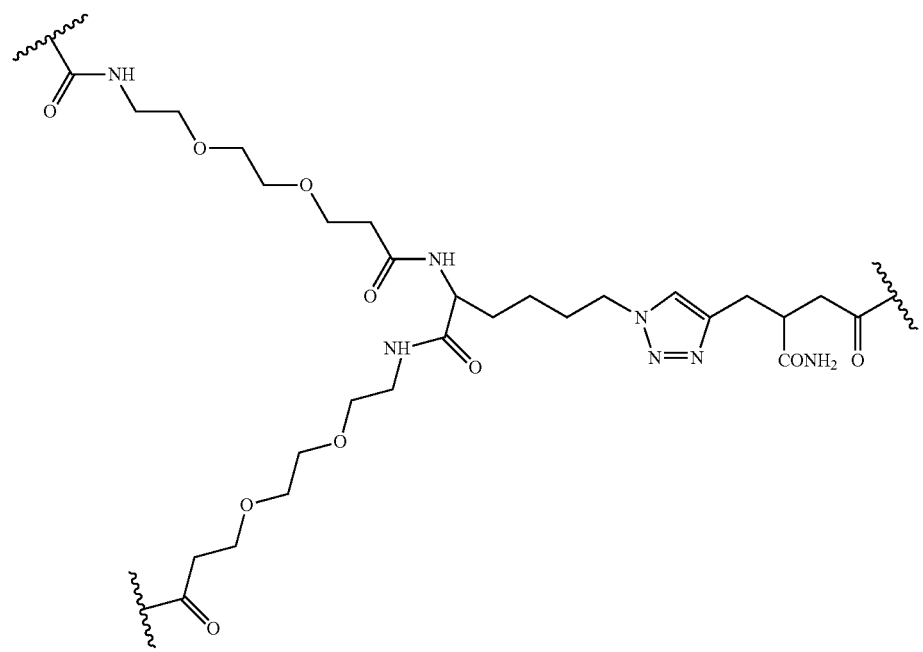

-continued

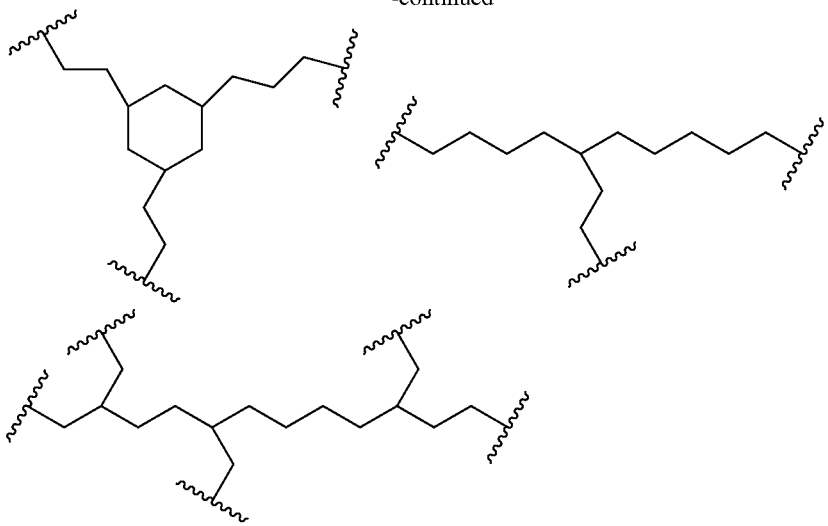

A branched ligand provided by the present disclosure can comprise disulfide bonds. For example, an IL-2Rβ ligand, an IL-7Rα ligand, and/or an Rγc ligand can comprise at least two cysteines. A cysteine of a branched ligand can be bound to another cysteine of the branched ligand through a disulfide bond. Each of the at least two cysteines of an IL-2Rβ ligand can be bound to another cysteine of the IL-2Rβ ligand or can be bound to a cysteine of the IL-7Rα ligand or to a cysteine of the Rγc ligand. Each of the at least two cysteines of an IL-7Rα ligand can be bound to another cysteine of the IL-7Rα ligand or can be bound to a cysteine of the IL-2Rβ ligand or to a cysteine of the Rγc ligand. Each of the at least two cysteines of an Rγc ligand can be bound to another cysteine of the Rγc ligand or can be bound to a cysteine of the IL-2Rβ ligand or to a cysteine of the IL-7Rα ligand.

In a branched ligand, two cysteines of an IL-7Rα ligand can be covalently bound together through a disulfide bond, two cysteines of an IL-2Rβ ligand can be covalently bound together through a disulfide bond, and two cysteines of an Rγc ligand can be covalently bound together through a disulfide bond.

For example, in a branched ligand having the structure of Formula (107):

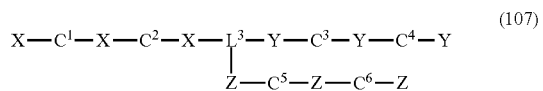

where, $L^3$ is a trifunctional core of the branched ligand, $-X-C^1-X-C^2-X$ represents an amino acid sequence of an IL-2Rβ ligand having two cysteines, $C^1$ and $C^2$, $-Y-C^3-Y-C^4-Y$ represents an amino acid sequence of an IL-7Rα ligand having two cysteines, $C^3$ and $C^4$, and $-Z-C^5-Z-C^6-Z$ represents an Rγc ligand having two cysteines $C^5$ and $C^6$.

For example, in a branched ligand of Formula (107), $C^1$ can be bound to $C^2$ through a disulfide bond, $C^3$ can be bound to $C^4$ through a disulfide bond, and $C^5$ and can be bound to $C^6$ through a disulfide bond.

In a branched ligand of Formula (107), $C^1$ can be bound to $C^2$, $C^3$, $C^4$, $C^5$, or $C^6$ through a disulfide bond; $C^2$ can be bound to $C^1$, $C^3$, $C^4$, $C^5$, or $C^6$ through a disulfide bond; $C^3$ can be bound to $C^1$, $C^2$, $C^4$, $C^5$, or $C^6$ through a disulfide bond; $C^4$ can be bound to $C^1$, $C^2$, $C^3$, $C^5$, or $C^6$ through a disulfide bond; $C^5$ can be bound to $C^1$, $C^2$, $C^3$, $C^4$, or $C^6$ through a disulfide bond; and/or $C^6$ can be bound to $C^1$, $C^2$, $C^3$, $C^4$, or $C^5$ through a disulfide bond;

Branched ligands provided by the present disclosure can have a preferred pattern of cysteine-cysteine bonds (disulfide bridges) that exhibit the greatest activity such as, for example, branched ligands in which $C^1$ is bonded to $C^2$, $C^3$ is bonded to $C^4$, and $C^5$ is bonded to $C^6$, or other disulfide patterns can exhibit desired activity and have useful properties.

An IL-2Rβ ligand provided by the present disclosure can comprise an IL-2Rβ ligand of any one of SEQ ID NOS: 1-565, a truncated amino acid sequence of any one of SEQ ID NOS: 1-565, a substituted amino acid sequence of any one of SEQ ID NOS: 1-565, or an amino acid sequence having a sequence similarity greater than greater than 60%, greater than 70%, greater than 75%, greater than 80%, greater than 85%, greater than 90%, or greater than 95% to any of the foregoing sequences.

An IL-2Rβ ligand provided by the present disclosure can bind to the human IL-2Rβ subunit with an $IC_{50}$ of less than 100 μM, less than 10 μM, less than 1 μM, less than 0.1 μM, or less than 0.01 μM.

An IL-2Rβ ligand can bind to the human IL-2Rβ subunit with an $IC_{50}$ from 1 pM to 100 μM, from 10 pM to 10 μM, from 100 pM to 1 μM, from 0.001 μM to 1 μM, or from 0.01 μM to 1 μM.

An IL-2Rβ ligand provided by the present disclosure can bind to a mammalian IL-2Rβ subunit with an $IC_{50}$ of less than 100 μM, less than 10 μM, less than 1 μM, less than 0.1 μM, or less than 0.01 μM.

An IL-2Rβ ligand can bind to a mammalian IL-2Rβ subunit with an $IC_{50}$ from 1 pM to 100 μM, from 10 pM to 10 μM, from 100 pM to 1 μM, from 0.001 μM to 1 μM, or from 0.01 μM to 1 μM.

An IL-2Rβ ligand provided by the present disclosure can bind to each of the human IL-2Rβ subunit and to the human Rγc subunit of IL-2R with an $IC_{50}$ of less than 100 μM, less than 10 μM, less than 1 μM, less than 0.1 μM, or less than 0.01 μM.

An IL-2Rβ ligand can bind to each of the human IL-2Rβ subunit and to the human Rγc subunit of IL-2R with an $IC_{50}$ from 1 pM to 100 µM, from 10 pM to 10 µM, from 100 pM to 1 µM, from 0.001 µM to 1 µM, or from 0.01 µM to 1 µM.

An IL-2Rβ ligand can bind to the human IL-2Rα (CD25) subunit with an IC$_{50}$ greater than 100 µM, greater than 1 mM, greater than 10 mM, or greater than 100 mM.

An IL-2Rβ ligand can bind to the human IL-2Rβ subunit with an IC$_{50}$ that is at least 10 times greater than the IC$_{50}$ of the IL-2Rβ ligand to the human IL-2Rα subunit, at least 50 times greater, at least 100 times greater, at least 500 times greater, or at least 1,000 times greater.

An IL-2Rβ ligand can have the amino acid sequence of Formula (1) (SEQ ID NO: 1), an amino acid sequence of Formula (1a) (SEQ ID NO: 2), an amino acid sequence of Formula (1b) (SEQ ID NO: 3), or an amino acid sequence of Formula (1c) (SEQ ID NO: 4):

$$-X^3-X^4-X^5-X^6-X^7-X^8-X^9-X^{10}- \quad (1)$$

$$-C-X^3-X^4-X^5-X^6-X^7-X^8-X^9-X^{10}-C- \quad (1a)$$

$$-X^2-C-X^3-X^4-X^5-X^6-X^7-X^8-X^9-X^{10}-C-X^{11}- \quad (1b)$$

$$-X^1-X^2-C-X^3-X^4-X^5-X^6-X^7-X^8-X^9-X^{10}-C-X^{11}-X^{12}- \quad (1c)$$

wherein, $X^1$ can be selected from A, D, E, F, G, I, K, L, M, N, P, Q, S, T, V, W, and Y;

$X^2$ can be selected from A, C, D, E, F, G, H, K, L, N, P, R, S, T, W, and Y;

$X^3$ can be selected from A, D, E, F, G, H, M, N, Q, R, S, T, W, and Y;

$X^4$ can be selected from A, D, E, F, G, I, K, L, M, N, Q, R, S, T, V, and Y;

$X^5$ can be selected from A, G, I, Q, S, T, V, and W;

$X^6$ can be selected from A, D, E, G, H, K, L, M, N, P, Q, R, S, T, and V;

$X^7$ can be selected from F, I, K, L, Q, and V;

$X^8$ can be selected from D, F, G, H, M, N, W, and Y;

$X^9$ can be selected from A, D, E, M, P, Q, S, T, V, and W;

$X^{10}$ can be selected from D, F, I, L, M, S, T, V, and Y;

$X^{11}$ can be selected from D, E, F, H, I, L, M, Q, S, T, V, W, and Y; and $X^{12}$ can be selected from F, I, L, M, N, S, V, W, and Y.

In IL-2Rβ ligands of Formula (1)-(1c), $X^1$ can be selected from F, I, L, M, and V.

In IL-2Rβ ligands of Formula (1)-(1c), $X^2$ can be selected from D, E, F, G, H, L, N, P, R, S, T, W, and Y.

In IL-2Rβ ligands of Formula (1)-(1c), $X^5$ can be A.

In IL-2Rβ ligands of Formula (1)-(1c), $X^6$ can be selected from D, E, and Q.

In IL-2Rβ ligands of Formula (1)-(1c), $X^7$ can be selected from F, I, L, and V.

In IL-2Rβ ligands of Formula (1)-(1c), $X^8$ can be G.

In IL-2Rβ ligands of Formula (1)-(1c), $X^9$ can be selected from D, E, and Q.

In IL-2Rβ ligands of Formula (1)-(1c), $X^{10}$ can be selected from F, I, L, M, V, and Y.

In IL-2Rβ ligands of Formula (1)-(1c), $X^{11}$ can be selected from D and E.

In IL-2Rβ ligands of Formula (1)-(1c), $X^{12}$ can be selected from F, I, L, M, and V.

In IL-2Rβ ligands of Formula (1)-(1c), the IL-2Rβ ligand can be defined by any combination of $X^1$-$X^{12}$ as defined in the immediately preceding eleven (11) paragraphs.

In IL-2Rβ ligands of Formula (1)-(1c), $X^1$ can be selected from F, I, L, M, and V;

$X^2$ can be selected from D, E, F, G, H, L, N, P, R, S, T, W, and Y;

$X^3$ can be selected from A, D, E, F, G, H, M, N, Q, R, S, T, W, and Y;

$X^4$ can be selected from A, D, E, F, G, I, K, L, M, N, Q, R, S, T, V, and Y;

$X^5$ can be A;

$X^6$ can be selected from D, E, and Q;

$X^7$ can be selected from F, I, L, and V;

$X^8$ can be G;

$X^9$ can be selected from D, E, and Q;

$X^{10}$ can be selected from F, I, L, M, V, and Y;

$X^{11}$ can be selected from D and E; and $X^{12}$ can be selected from F, I, L, M, and V.

An IL-2Rβ ligand can comprise the amino acid sequence of Formula (1) (SEQ ID NO: 1), an amino acid sequence of Formula (1a) (SEQ ID NO: 2), an amino acid sequence of Formula (1b) (SEQ ID NO: 3), or an amino acid sequence of Formula (1c) (SEQ ID NO: 4):

$$-X^3-X^4-X^5-X^6-X^7-X^8-X^9-X^{10}- \quad (1)$$

$$-C-X^3-X^4-X^5-X^6-X^7-X^8-X^9-X^{10}-C- \quad (1a)$$

$$-X^2-C-X^3-X^4-X^5-X^6-X^7-X^8-X^9-X^{10}-C-X^{11}- \quad (1b)$$

$$-X^1-X^2-C-X^3-X^4-X^5-X^6-X^7-X^8-X^9-X^{10}-C-X^{11}-X^{12}- \quad (1c)$$

wherein, $X^1$ can be selected from an amino acid $X^2$ can be selected from an amino acid;

$X^3$ can be selected from an amino acid;

$X^4$ can be selected from an amino acid;

$X^5$ can be selected from an amino acid comprising a small hydrophobic side chain;

$X^6$ can be selected from an amino acid;

$X^7$ can be selected from an amino acid comprising a large hydrophobic side chain;

$X^8$ can be selected from an amino acid comprising a small hydrophobic side chain;

$X^9$ can be selected from an amino acid comprising a polar-neutral or an acidic side chain;

$X^{10}$ can be selected from an amino acid comprising a large hydrophobic side chain;

$X^{11}$ can be selected from an amino acid; and $X^{12}$ can be selected from an amino acid comprising a large hydrophobic side chain.

In IL-2Rβ ligands of Formula (1)-(1c), $X^1$ can be selected from an amino acid comprising a large hydrophobic side chain;

$X^2$ can be selected from an amino acid;

$X^3$ can be selected from an amino acid;

$X^4$ can be selected from an amino acid;

$X^5$ can be selected from an amino acid comprising a small hydrophobic side chain;

$X^6$ can be selected from an amino acid comprising a polar-neutral or an acidic side chain;

$X^7$ can be selected from an amino acid comprising a large hydrophobic side chain;

$X^8$ can be selected from an amino acid comprising a small hydrophobic side chain;

$X^9$ can be selected from an amino acid comprising a polar-neutral or an acidic side chain;

$X^{10}$ can be selected from an amino acid comprising a large hydrophobic side chain;

$X^{11}$ can be selected from an amino acid comprising a polar-neutral or an acidic side chain; and $X^{12}$ can be selected from an amino acid comprising a large hydrophobic side chain.

In IL-2Rβ ligands of Formula (1)-(1c),
$X^1$ can be selected from I, L, M, V, F, W, and Y;
$X^2$ can be selected from an amino acid;
$X^3$ can be selected from an amino acid;
$X^4$ can be selected from an amino acid;
$X^5$ can be selected from A, G, P, S, and T;
$X^6$ can be selected from H, N, Q, S, T, Y, D, and E;
$X^7$ can be selected from I, L, M, V, F, W, and Y;
$X^8$ can be selected from A, G, P, S, and T;
$X^9$ can be selected from H, N, Q, S, T, Y, D, and E;
$X^{10}$ can be selected from I, L, M, V, F, W, and Y;
$X^{11}$ can be selected from H, N, Q, S, T, Y, D, and E; and
$X^{12}$ can be selected from I, L, M, V, F, W, and Y.
In IL-2Rβ ligands of Formula (1)-(1c),
$X^1$ can be selected from I, L, M, V, F, W, and Y;
$X^2$ can be selected from an amino acid;
$X^3$ can be selected from an amino acid;
$X^4$ can be selected from an amino acid;
$X^5$ can be A;
$X^6$ can be selected from H, N, Q, S, T, Y, D, and E;
$X^7$ can be selected from I, L, M, V, F, W, and Y;
$X^8$ can be G;
$X^9$ can be selected from H, N, Q, S, T, Y, D, and E;
$X^{10}$ can be selected from I, L, M, V, F, W, and Y;
$X^{11}$ can be selected from H, N, Q, S, T, Y, D, and E; and
$X^{12}$ can be selected from I, L, M, V, F, W, and Y.
In IL-2Rβ ligands of Formula (1)-(1c), $X^1$ can be selected from I, L, M, and V.
In IL-2Rβ ligands of Formula (1)-(1c), $X^2$ can be selected from D and E.
In IL-2Rβ ligands of Formula (1)-(1c), $X^6$ can be selected from Q, E, and D.
In IL-2Rβ ligands of Formula (1)-(1c), $X^7$ can be selected from V, L, and I.
In IL-2Rβ ligands of Formula (1)-(1c), $X^9$ can be selected from E, D, and Q.
In IL-2Rβ ligands of Formula (1)-(1c), $X^{10}$ can be selected from L, V, I, and Y.
In IL-2Rβ ligands of Formula (1)-(1c), $X^{11}$ can be selected from D and E.
In IL-2Rβ ligands of Formula (1)-(1c), $X^{12}$ can be selected from L, I, and F.
In IL-2Rβ ligands of Formula (1)-(1c), the IL-2Rβ ligand can be defined by any combination of $X^1$-$X^{12}$ as defined in the immediately preceding eight (8) paragraphs.
In IL-2Rβ ligands of Formula (1)-(1c),
$X^1$ can be selected from L, I, F, and V;
$X^2$ can be selected from D and E;
$X^3$ can be selected from and amino acid;
$X^4$ can be selected from an amino acid;
$X^5$ can be A;
$X^6$ can be selected from Q, E, and D;
$X^7$ can be selected from V, L, and I;
$X^8$ can be G;
$X^9$ can be selected from E, D, and Q;
$X^{10}$ can be selected from L, V, I, and Y;
$X^{11}$ can be selected from D and E; and
$X^{12}$ can be selected from L, I, and F.
In IL-2Rβ ligands of Formula (1)-(1c),
$X^1$ can be selected from F, I, M, and Y;
$X^2$ can be selected from E, D, and R;
$X^3$ can be selected from and amino acid;
$X^4$ can be selected from an amino acid;
$X^5$ can be A;
$X^6$ can be selected from A, P, and Q;
$X^7$ can be selected from I and V;
$X^8$ can be G;
$X^9$ can be selected from E and Q;
$X^{10}$ can be selected from I, L, and V;
$X^{11}$ can be selected from E, D, and Q; and
$X^{12}$ can be selected from I and L.

An IL-2Rβ ligand can comprise an amino acid sequence selected from any one of SEQ ID NOS: 5-164:

| | |
|---|---|
| A F C D E A R V G E L C V M | SEQ ID NO: 5 |
| A L C Q A A Q V G Q L C D L | SEQ ID NO: 6 |
| A I A Q L Y D L | SEQ ID NO: 7 |
| A Q A T V G Q Y | SEQ ID NO: 8 |
| C C Y Q A M V G D L C D F C | SEQ ID NO: 9 |
| D D C S T A Q V G E L C V M | SEQ ID NO: 10 |
| D T C A I A Q L Y D L C D L | SEQ ID NO: 11 |
| D Y C R N S N V G D V C Y L | SEQ ID NO: 12 |
| D H C S E A Q I G Q L D H L | SEQ ID NO: 13 |
| D P C Y A A V L N S L C D I | SEQ ID NO: 14 |
| D S C Q N A P L G S Y C V L | SEQ ID NO: 15 |
| D E A R V G E L | SEQ ID NO: 16 |
| D Q A T L G Q I | SEQ ID NO: 17 |
| D M A D L F T L | SEQ ID NO: 18 |
| D T A A V G D L | SEQ ID NO: 19 |
| D K A T V G Q M | SEQ ID NO: 20 |
| D V A S V G S Y | SEQ ID NO: 21 |
| E D C R Y A E V G V L C Q M | SEQ ID NO: 22 |
| E R A Q I G E V | SEQ ID NO: 23 |
| E V A R L G D Y | SEQ ID NO: 24 |
| E Y S K V G E V | SEQ ID NO: 25 |
| E V A K V G E L | SEQ ID NO: 26 |
| E D A L L G D F | SEQ ID NO: 27 |
| E Y A T L G S L | SEQ ID NO: 28 |

| | |
|---|---|
| F D C Q T A E L G D L C I V | |
| F F C Y L I G Q D E F C E F | SEQ ID NO: 29 |
| F P C Q I A M I G E Y C D W | SEQ ID NO: 30 |
| F R C W E A P V G E I C E L | SEQ ID NO: 31 |
| F S C D Q A T L G Q I C V I | SEQ ID NO: 32 |
| F E A Q I G M I | SEQ ID NO: 33 |
| F L A A V G Q I | SEQ ID NO: 34 |
| F Q A P I G S L | SEQ ID NO: 35 |
| F Q A Q V G Q L | SEQ ID NO: 36 |
| F Y A T L G Q V | SEQ ID NO: 37 |
| G D C Y F S Q I G E L C M L | SEQ ID NO: 38 |
| G P C Q Q A K L G E L C D L | SEQ ID NO: 39 |
| G V W D L W P D | SEQ ID NO: 40 |
| G D A Q L G E V | SEQ ID NO: 41 |
| G I A L Q G Q L | SEQ ID NO: 42 |
| G I A Q I G Q V | SEQ ID NO: 43 |
| G D A S L G Q L | SEQ ID NO: 44 |
| H L A Q V G E F | SEQ ID NO: 45 |
| H Q A Q I G E L | SEQ ID NO: 46 |
| I D C A Q A T V G Q Y C T L | SEQ ID NO: 47 |
| I D C S D A A V G A L C T Q | SEQ ID NO: 48 |
| I D C T R A S L G D I C V W | SEQ ID NO: 49 |
| I E C E R A Q I G E V C Q I | SEQ ID NO: 50 |
| I F C G D A Q L G E V C S L | SEQ ID NO: 51 |
| I F C Q F A R L G Q T C Q L | SEQ ID NO: 52 |
| I P C S I A Q L F S L C D V | SEQ ID NO: 53 |
| I P C Y L A E L G Q V C S L | SEQ ID NO: 54 |
| I R C E D A L L G D F C I F | SEQ ID NO: 55 |
| I G C S L A R L G E Y C V I | SEQ ID NO: 56 |
| I P C S V A R V G W L C D L | SEQ ID NO: 57 |
| K N C E V A R L G D Y C E I | SEQ ID NO: 58 |
| L A C S Q A P L G T L C E I | SEQ ID NO: 59 |
| L D C G I A L Q G Q L C D Y | SEQ ID NO: 60 |
| L D C S L S S L G D Y C Y M | SEQ ID NO: 61 |
| L G C F E A Q I G M I C D L | SEQ ID NO: 62 |
| L H C Y L A V L G Q L C D V | SEQ ID NO: 63 |
| L L C Q V A S L G D Y C T I | SEQ ID NO: 64 |
| L P C D M A D L F T L C D Y | SEQ ID NO: 65 |
| L S C G I A Q I G Q V C D M | SEQ ID NO: 66 |
| L W C Q D A Q I G D V C W L | SEQ ID NO: 67 |
| L F C H Q A Q I G E L C S V | SEQ ID NO: 68 |
| L E C W Q A Q K G D L C D L | SEQ ID NO: 69 |
| L W C G D A S L G Q L C W L | SEQ ID NO: 70 |
| L D C F Y A T L G Q V C S L | SEQ ID NO: 71 |
| L P C S L A K L H E L C D I | SEQ ID NO: 72 |
| L S C S D A Q L M Q L C E I | SEQ ID NO: 73 |
| M E C F L A A V G Q I C E L | SEQ ID NO: 74 |
| M F C Q T A E V G Q M C L L | SEQ ID NO: 75 |
| M L C W E A P V G D V C T I | SEQ ID NO: 76 |
| M D C S D A H V G Q I C S I | SEQ ID NO: 77 |
| M M S S L G D L | SEQ ID NO: 78 |
| N F C S G A G L G E L C V I | SEQ ID NO: 79 |
| N L C E Y S K V G E V C V F | SEQ ID NO: 80 |
| N Y C Y Q A L L D T Y C I L | SEQ ID NO: 81 |
| | SEQ ID NO: 82 |

| | |
|---|---|
| NLAQIGDL | SEQ ID NO: 83 |
| PDCWYAGLGQICEF | SEQ ID NO: 84 |
| PSCWMAQVGDLCFI | SEQ ID NO: 85 |
| PTCDTAAVGDLCEF | SEQ ID NO: 86 |
| PDCSVALLGESCSV | SEQ ID NO: 87 |
| PDCSEALLGQICTY | SEQ ID NO: 88 |
| QDCSSASVGTICYL | SEQ ID NO: 89 |
| QECGVWDLWPDCWI | SEQ ID NO: 90 |
| QDCFQAPIGSLCYL | SEQ ID NO: 91 |
| QWCYMTDVGDLCEL | SEQ ID NO: 92 |
| QACEVAKVGELCDL | SEQ ID NO: 93 |
| QTAELGDL | SEQ ID NO: 94 |
| QIAMIGEY | SEQ ID NO: 95 |
| QQAKLGEL | SEQ ID NO: 96 |
| QFARLGQT | SEQ ID NO: 97 |
| QVASLGDY | SEQ ID NO: 98 |
| QDAQIGDV | SEQ ID NO: 99 |
| QTAEVGQM | SEQ ID NO: 100 |
| QVGDFWDV | SEQ ID NO: 101 |
| QAAQVGQL | SEQ ID NO: 102 |
| QNAPLGSY | SEQ ID NO: 103 |
| RNSNVGDV | SEQ ID NO: 104 |
| RYAEVGVL | SEQ ID NO: 105 |
| RIAQVGEL | SEQ ID NO: 106 |
| SDCHLAQVGEFCFL | SEQ ID NO: 107 |
| SDCYLSQVGSLCDF | SEQ ID NO: 108 |
| SPCSEASLFQLCDL | SEQ ID NO: 109 |
| SWCQVGDFWDVCTS | SEQ ID NO: 110 |
| SGCEYATLGSLCDL | SEQ ID NO: 111 |
| SLCSLAPLGSLCDL | SEQ ID NO: 112 |
| SLCSMVGLGQLCDL | SEQ ID NO: 113 |
| SSASVGTI | SEQ ID NO: 114 |
| STAQVGEL | SEQ ID NO: 115 |
| SDAAVGAL | SEQ ID NO: 116 |
| SIAQLFSL | SEQ ID NO: 117 |
| SQAPLGTL | SEQ ID NO: 118 |
| SLSSLGDY | SEQ ID NO: 119 |
| SGAGLGEL | SEQ ID NO: 120 |
| SEASLFQL | SEQ ID NO: 121 |
| SSVQVGEL | SEQ ID NO: 122 |
| SEALLGQI | SEQ ID NO: 123 |
| SRAVVGEL | SEQ ID NO: 124 |
| SVALLGES | SEQ ID NO: 125 |
| SLARLGEY | SEQ ID NO: 126 |
| SDAHVGQI | SEQ ID NO: 127 |
| SEAQIGQL | SEQ ID NO: 128 |
| SEALLGQI | SEQ ID NO: 129 |
| SLAPLGSL | SEQ ID NO: 130 |
| SMVGLGQL | SEQ ID NO: 131 |
| SVARVGWL | SEQ ID NO: 132 |
| SLAKLHEL | SEQ ID NO: 133 |
| SDAQLMQL | SEQ ID NO: 134 |
| TECWLQALGELCDF | SEQ ID NO: 135 |
| TGCNLAQIGDLCDL | SEQ ID NO: 136 |

TGCWQAPVGSLCEL — SEQ ID NO: 137

TRASLGDI — SEQ ID NO: 138

VACSSVQVGELCDF — SEQ ID NO: 139

VECMMSSLGDLCSF — SEQ ID NO: 140

VNCWEAQVGWLCDW — SEQ ID NO: 141

VTCDKATVGQMCSI — SEQ ID NO: 142

VDCSRAVVGELCVN — SEQ ID NO: 143

WSCDVASVGSYCML — SEQ ID NO: 144

WEAPVGEI — SEQ ID NO: 145

WEAPVGDV — SEQ ID NO: 146

WYAGLGQI — SEQ ID NO: 147

WMAQVGDL — SEQ ID NO: 148

WLQALGEL — SEQ ID NO: 149

WEAQVGWL — SEQ ID NO: 150

WQAQKGDL — SEQ ID NO: 151

WQAPVGSL — SEQ ID NO: 152

XDCSEALLGQICTY — SEQ ID NO: 153

YDCRIAQVGELCDL — SEQ ID NO: 154

YECFQAQVGQLCDV — SEQ ID NO: 155

YLIGQDEF — SEQ ID NO: 156

YFSQIGEL — SEQ ID NO: 157

YLAELGQV — SEQ ID NO: 158

YLAVLGQL — SEQ ID NO: 159

YQALLDTY — SEQ ID NO: 160

YMTDVGDL — SEQ ID NO: 161

YLSQVGSL — SEQ ID NO: 162

YAAVLNSL — SEQ ID NO: 163

YQAMVGDL — SEQ ID NO: 164

An IL-2Rβ ligand provided by the present disclosure can comprise a truncated amino acid sequence of any one of SEQ ID NOS: 1-164.

An IL-2Rβ ligand provided by the present disclosure can comprise an amino acid sequence selected from any one of SEQ ID NOS: 1-164, or a truncated amino acid sequence of any one of SEQ ID NOS: 1-164, wherein the amino acid sequence can independently comprise from 1 to 4 glycines (G) on the N-terminus, on the C-terminus, or on both the N- and C-termini.

An IL-2Rβ ligand provided by the present disclosure can comprise an amino acid sequence selected from any one of SEQ ID NOS: 1-164, or a truncated amino acid sequence of any one of SEQ ID NOS: 1-164, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 1-164 or to a truncated amino acid sequence of any one of SEQ ID NOS: 1-164.

An IL-2Rβ ligand of anyone of SEQ ID NOS: 1-164 can bind to the hIL-2Rβ subunit with an $IC_{50}$ of less than 10 μM as determined using phage ELISA competition assays.

An IL-2Rβ ligand of any one of SEQ ID NOS: 1-164, a truncated IL-2Rβ ligand of any one of SEQ ID NOS: 1-164, or a substituted IL-2Rβ ligand of any one of SEQ ID NOS: 1-164 can bind to the hIL-2Rβ subunit with an $IC_{50}$ of less than 100 μM or less than 10 μM as determined using phage ELISA competition assays.

An IL-2Rβ ligand of anyone of SEQ ID NOS: 5-164 bind to the hIL-2Rβ subunit with an $IC_{50}$ of less than 100 μM.

An IL-2Rβ ligand can comprise an amino acid sequence of Formula (2) (SEQ ID NO: 165), an amino acid sequence of Formula (2a) (SEQ ID NO: 166), an amino acid sequence of Formula (2b) (SEQ ID NO: 167), or the amino acid sequence of Formula (2c) (SEQ ID NO: 168):

$$-X^3-X^4-X^5-X^6-X^7-X^8-X^9-X^{10}- \quad (2)$$

$$-C-X^3-X^4-X^5-X^6-X^7-X^8-X^9-X^{10}-C- \quad (2a)$$

$$-X^2-C-X^3-X^4-X^5-X^6-X^7-X^8-X^9-X^{10}-C-X^{11}- \quad (2b)$$

$$-X^1-X^2-C-X^3-X^4-X^5-X^6-X^7-X^8-X^9-X^{10}-C-X^{11}-X^{12}- \quad (2c)$$

wherein,
$X^1$ can be selected from A, D, E, G, N, Q, R, and V;
$X^2$ can be selected from E, F, I, L, M, and Q;
$X^3$ can be selected from D, G, L, and N;
$X^4$ can be selected from L, P, V, and Y;
$X^5$ can be selected from F, G, and M;
$X^6$ can be selected from A, D, N, and Q;
$X^7$ can be selected from F, I, L, S, V, W, and Y;
$X^8$ can be selected from D and W;
$X^9$ can be selected from P and Y;
$X^{10}$ can be selected from A, D, Q, and S;
$X^{11}$ can be selected from I, L, Q, W, and Y; and
$X^{12}$ can be selected from E, F, I, L, T, V, and W.

In IL-2Rβ ligands of Formula (2)-(2c), $X^4$ can be V.
In IL-2Rβ ligands of Formula (2)-(2c), $X^5$ can be G.
In IL-2Rβ ligands of Formula (2)-(2c), $X^6$ can be W.
In IL-2Rβ ligands of Formula (2)-(2c), $X^7$ can be P.
In IL-2Rβ ligands of Formula (2)-(2c), the IL-2Rβ ligand can be defined by any combination of $X^1$-$X^7$ as defined in the immediately preceding four (4) paragraphs.

In IL-2Rβ ligands of Formula (2)-(2c),
$X^1$ can be selected from E, N, and Q;
$X^2$ can be selected from I and M;
$X^3$ can be selected from D, L, and N;
$X^4$ can be V;
$X^5$ can be G;
$X^6$ can be selected from D and Q;
$X^7$ can be selected from V, W, and Y;
$X^8$ can be W;
$X^9$ can be P;
$X^{10}$ can be selected from D and S;
$X^{11}$ can be selected from L and Q; and
$X^{12}$ can be selected from I, L, and V.

An IL-2Rβ ligand can comprise an amino acids sequence selected from any one of SEQ ID NO: 169 to SEQ ID NO: 184:

| | |
|---|---|
| A E C G V G A I W P S C L W | SEQ ID NO: 169 |
| D F C L V G D L W P S C W L | SEQ ID NO: 170 |
| D V G Q W W P D | SEQ ID NO: 171 |
| D Y M N S D Y Q | SEQ ID NO: 172 |
| D L F A I W P D | SEQ ID NO: 173 |
| E I C N V G Q V W P D C L L | SEQ ID NO: 174 |
| G Q C L P G D F W P A C Y E | SEQ ID NO: 175 |
| G V G A I W P S | SEQ ID NO: 176 |
| L P G D F W P A | SEQ ID NO: 177 |
| L V G D Y W P S | SEQ ID NO: 178 |
| L V G D L W P S | SEQ ID NO: 179 |
| N M C L V G D Y W P S C Q I | SEQ ID NO: 180 |
| N V G Q V W P D | SEQ ID NO: 181 |
| Q I C D V G Q W W P D C Q V | SEQ ID NO: 182 |
| R L C D L F A I W P D C L F | SEQ ID NO: 183 |
| V L C D Y M N S D Y Q C I T | SEQ ID NO: 184 |

An IL-2Rβ ligand provided by the present disclosure can comprise a truncated amino acid sequence of any one of SEQ ID NOS: 165-184.

An IL-2Rβ ligand provided by the present disclosure can comprise an amino acid sequence selected from any one of SEQ ID NOS: 165-184, or a truncated amino acid sequence of any one of SEQ ID NOS: 165-184, wherein the amino acid sequence can independently comprise from 1 to 4 glycines (G) (SEQ ID NO: 9615) on the N-terminus, on the C-terminus, or on both the N- and C-termini.

An IL-2Rβ ligand provided by the present disclosure can comprise an amino acid sequence selected from any one of SEQ ID NOS: 165-184, or a truncated amino acid sequence of any one of SEQ ID NOS: 165-184, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 165-184 or to a truncated amino acid sequence of any one of SEQ ID NOS: 165-184.

An IL-2Rβ ligand of any one of SEQ ID NOS: 165-184 can bind to the hIL-2Rβ subunit with an $IC_{50}$ of less than 10 μM as determined using phage ELISA competition assays.

An IL-2Rβ ligand of any one of SEQ ID NOS: 165-184, a truncated IL-2Rβ ligand of any one of SEQ ID NOS: 165-184, or a substituted IL-2Rβ ligand of any one of SEQ ID NOS: 164-184 can bind to the hIL-2Rβ subunit with an $IC_{50}$ of less than 100 μM or less than 10 μM as determined using phage ELISA competition assays.

An IL-2Rβ ligand of any one of SEQ ID NOS: 169-184 bind to the hIL-2Rβ subunit with an $IC_{50}$ of less than 100 μM.

An IL-2Rβ ligand can comprise an amino acid sequence of Formula (2) (SEQ ID NO: 165), an amino acid sequence of Formula (2a) (SEQ ID NO: 166), the amino acid sequence of Formula (2b) (SEQ ID NO: 167), or an amino acid sequence of Formula (2c) (SEQ ID NO: 168):

$$-X^3\text{-}X^4\text{-}X^5\text{-}X^6\text{-}X^7\text{-}X^8\text{-}X^9\text{-}X^{10}\text{-} \quad (2)$$

$$-C\text{-}X^3\text{-}X^4\text{-}X^5\text{-}X^6\text{-}X^7\text{-}X^8\text{-}X^9\text{-}X^{10}\text{-}C\text{-} \quad (2a)$$

$$-X^2\text{-}C\text{-}X^3\text{-}X^4\text{-}X^5\text{-}X^6\text{-}X^7\text{-}X^8\text{-}X^9\text{-}X^{10}\text{-}C\text{-}X^{11}\text{-} \quad (2b)$$

$$-X^1\text{-}X^2\text{-}C\text{-}X^3\text{-}X^4\text{-}X^5\text{-}X^6\text{-}X^7\text{-}X^8\text{-}X^9\text{-}X^{10}\text{-}C\text{-}X^{11}\text{-}X^{12}\text{-} \quad (2c)$$

wherein,
$X^1$ can be selected from an amino acid;
$X^2$ can be selected from an amino acid comprising a large hydrophobic side chain;
$X^3$ can be selected from an amino acid;
$X^4$ can be selected from an amino acid comprising a large hydrophobic side chain;
$X^5$ can be selected from an amino acid comprising a small hydrophobic side chain;
$X^6$ can be selected from an amino acid;
$X^7$ can be selected from an amino acid;
$X^8$ can be selected from an amino acid comprising a large hydrophobic side chain;
$X^9$ can be selected from an amino acid comprising a small hydrophobic side chain;
$X^{10}$ can be selected from an amino acid;
$X^{11}$ can be selected from an amino acid; and
$X^{12}$ can be selected from an amino acid comprising a large hydrophobic side chain.

In IL-2Rβ ligands of Formula (2)-(2c), $X^1$ can be selected from an amino acid;

$X^2$ can be selected from an amino acid comprising a large hydrophobic side chain;

$X^3$ can be selected from an amino acid;

$X^4$ can be selected from an amino acid comprising a large hydrophobic side chain;

$X^5$ can be selected from an amino acid comprising a small hydrophobic side chain;

$X^6$ can be selected from an amino acid comprising a polar-neutral or an acidic side chain;

$X^7$ can be selected from an amino acid comprising large hydrophobic or neutral side chain;

$X^8$ can be selected from an amino acid comprising a large hydrophobic side chain;

$X^9$ can be selected from an amino acid comprising a small hydrophobic side chain;

$X^{10}$ can be selected from an amino acid;

$X^{11}$ can be selected from an amino acid; and $X^{12}$ can be selected from an amino acid comprising a large hydrophobic side chain.

In IL-2Rβ ligands of Formula (2)-(2c), $X^1$ can be selected from an amino acid;

$X^2$ can be selected from I, L, M, V, F, W, and Y;

$X^3$ can be selected from D, E, I, L, M, V, F, Y, and W;

$X^4$ can be selected from I, L, M, N, V, F, Y, and W;

$X^5$ can be selected from A, G, P, S, and T;

$X^6$ can be selected from H, N, Q, S, T, Y, D, and E;

$X^7$ can be selected from I, L, M, V, F, W, and Y;

$X^8$ can be selected from I, L, M, N, V, F, Y, and W;

$X^9$ can be selected from A, G, P, S, and T;

$X^{10}$ can be selected from an amino acid;

$X^{11}$ can be selected from an amino acid; and $X^{12}$ can be selected from I, L, M, V, F, W, and Y.

In IL-2Rβ ligands of Formula (2)-(2c), $X^2$ can be selected from I and M.

In IL-2Rβ ligands of Formula (2)-(2c), $X^4$ can be V.

In IL-2Rβ ligands of Formula (2)-(2c), $X^5$ can be G.

In IL-2Rβ ligands of Formula (2)-(2c), $X^6$ can be selected from D and Q.

In IL-2Rβ ligands of Formula (2)-(2c), $X^8$ can be W.

In IL-2Rβ ligands of Formula (2)-(2c), $X^9$ can be P.

In IL-2Rβ ligands of Formula (2)-(2c), $X^{11}$ can be selected from F, I, L, and V.

In IL-2Rβ ligands of Formula (2)-(2c), the IL-2Rβ ligand can be defined by any combination of $X^1$-$X^{11}$ as defined in the immediately preceding seven (7) paragraphs.

In IL-2Rβ ligands of Formula (2)-(2c), $X^1$ can be selected from an amino acid;

$X^2$ can be selected from I and M;

$X^3$ can be selected from an amino acid;

$X^4$ can be V;

$X^5$ can be G;

$X^6$ can be selected from D and Q;

$X^7$ can be selected from I, L, M, V, F, W, and Y;

$X^8$ can be W;

$X^9$ can be P;

$X^{10}$ can be selected from an amino acid;

$X^{11}$ can be selected from an amino acid; and $X^{12}$ can be selected from F, I, L, and V.

An IL-2Rβ ligand can comprise an amino acid sequence of Formula (3) (SEQ ID NO: 185), an amino acid sequence of Formula (3a) (SEQ ID NO: 186): or an amino acid sequence of Formula (3b) (SEQ ID NO: 187):

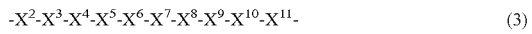

-$X^2$-$X^3$-$X^4$-$X^5$-$X^6$-$X^7$-$X^8$-$X^9$-$X^{10}$-$X^{11}$-  (3)

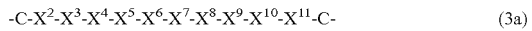

-C-$X^2$-$X^3$-$X^4$-$X^5$-$X^6$-$X^7$-$X^8$-$X^9$-$X^{10}$-$X^{11}$-C-  (3a)

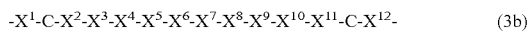

-$X^1$-C-$X^2$-$X^3$-$X^4$-$X^5$-$X^6$-$X^7$-$X^8$-$X^9$-$X^{10}$-$X^{11}$-C-$X^{12}$-  (3b)

wherein, $X^1$ can be selected from an amino acid;

$X^2$ can be selected from an amino acid;

$X^3$ can be selected from I and V;

$X^4$ can be G;

$X^5$ can be selected from D, E, and N;

$X^6$ can be selected from F, L, and Y;

$X^7$ can be selected from F, I, and V;

$X^8$ can be selected from D and Q;

$X^9$ can be selected from an amino acid;

$X^{10}$ can be selected from an amino acid;

$X^{11}$ can be selected from an amino acid; and $X^{12}$ can be selected from an amino acid.

In IL-2Rβ ligands of Formula (3)-(3b), $X^1$ can be selected from L, S, T, and Y;

$X^2$ can be selected from H and Q;

$X^3$ can be selected from I and V;

$X^4$ can be G;

$X^5$ can be selected from D, E, and N;

$X^6$ can be selected from F, L, and Y;

$X^7$ can be selected from F, I, and V;

$X^8$ can be selected from D and Q;

$X^9$ can be selected from D, L, and W;

$X^{10}$ can be selected from G, L, and T;

$X^{11}$ can be selected from D, I, and S; and $X^{12}$ can be selected from A and M.

An IL-2Rβ ligand can comprise the amino acid sequence of Formula (3) (SEQ ID NO: 185), the amino acid sequence of Formula (3a) (SEQ ID NO: 186), or the amino acid sequence of Formula (3b) (SEQ ID NO: 187):

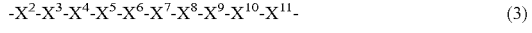

-$X^2$-$X^3$-$X^4$-$X^5$-$X^6$-$X^7$-$X^8$-$X^9$-$X^{10}$-$X^{11}$-  (3)

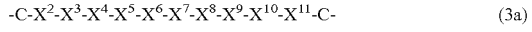

-C-$X^2$-$X^3$-$X^4$-$X^5$-$X^6$-$X^7$-$X^8$-$X^9$-$X^{10}$-$X^{11}$-C-  (3a)

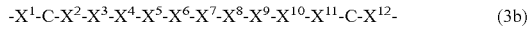

-$X^1$-C-$X^2$-$X^3$-$X^4$-$X^5$-$X^6$-$X^7$-$X^8$-$X^9$-$X^{10}$-$X^{11}$-C-$X^{12}$-  (3b)

wherein, $X^1$ can be selected from an amino acid;

$X^2$ can be selected from an amino acid;

$X^3$ can be selected from an amino acid comprising a large hydrophobic side chain;

$X^4$ can be selected from an amino acid comprising a small hydrophobic side chain;

$X^5$ can be selected from an amino acid comprising an acidic side chain or a polar neutral side chain;

$X^6$ can be selected from an amino acid;

$X^7$ can be selected from an amino acid;

$X^8$ can be selected from an amino acid comprising a polar-neutral side chain or an acidic side chain;

$X^9$ can be selected from an amino acid;

$X^{10}$ can be selected from an amino acid;

$X^{11}$ can be selected from an amino acid; and $X^{12}$ can be selected from an amino acid.

In IL-2Rβ ligands of Formula (3)-(3b), $X^1$ can be selected from an amino acid;

$X^2$ can be selected from an amino acid;

$X^3$ can be selected from an amino acid comprising a large hydrophobic side chain;

$X^4$ can be selected from an amino acid comprising a small hydrophobic side chain;
$X^5$ can be selected from an amino acid comprising an acidic side chain or a polar neutral side chain;
$X^6$ can be selected from an amino acid comprising a large hydrophobic side chain;
$X^7$ can be selected from an amino acid comprising a large hydrophobic side chain;
$X^8$ can be selected from an amino acid comprising a polar-neutral side chain or an acidic side chain;
$X^9$ can be selected from an amino acid;
$X^{10}$ can be selected from an amino acid;
$X^{11}$ can be selected from an amino acid; and
$X^{12}$ can be selected from an amino acid.

An IL-2Rβ ligand can comprise an amino acid sequence of Formula (3) (SEQ ID NO: 185), an amino acid sequence of Formula (3a) (SEQ ID NO: 186), or an amino acid sequence of Formula (3b) (SEQ ID NO: 187):

$$-X^2-X^3-X^4-X^5-X^6-X^7-X^8-X^9-X^{10}-X^{11}- \quad (3)$$

$$-C-X^2-X^3-X^4-X^5-X^6-X^7-X^8-X^9-X^{10}-X^{11}-C- \quad (3a)$$

$$-X^1-C-X^2-X^3-X^4-X^5-X^6-X^7-X^8-X^9-X^{10}-X^{11}-C-X^2- \quad (3b)$$

wherein,
$X^1$ can be selected from an amino acid;
$X^2$ can be selected from an amino acid;
$X^3$ can be selected from I, L, M, V, F, Y, and W;
$X^4$ can be selected from A, G, P, S, and T;
$X^5$ can be selected from D, E, H, N, Q, S, T, and Y;
$X^6$ can be selected from I, L, M, V, F, Y, and W;
$X^7$ can be selected from I, L, M, V, F, Y, and W;
$X^8$ can be selected from D, E, H, N, Q, T, and Y;
$X^9$ can be selected from an amino acid;
$X^{10}$ can be selected from an amino acid;
$X^{11}$ can be selected from an amino acid; and
$X^{12}$ can be selected from an amino acid.

In IL-2Rβ ligands of Formula (3)-(3b), $X^3$ can be selected from V and I.
In IL-2Rβ ligands of Formula (3)-(3b), $X^4$ can be G.
In IL-2Rβ ligands of Formula (3)-(3b), $X^5$ can be selected from D and E.
In IL-2Rβ ligands of Formula (3)-(3b), $X^6$ can be selected from V, L, F, and Y.
In IL-2Rβ ligands of Formula (3)-(3b), $X^7$ can be selected from I, V, and F.
In IL-2Rβ ligands of Formula (3)-(3b), $X^8$ can be selected from Q and D.
In IL-2Rβ ligands of Formula (3)-(3b), the IL-2Rβ ligand can be defined by any combination of $X^1$-$X^8$ as defined in the immediately preceding six (6) paragraphs.
In IL-2Rβ ligands of Formula (3)-(3b),
$X^1$ can be selected from an amino acid;
$X^2$ can be selected from an amino acid;
$X^3$ can be selected from V and I;
$X^4$ can be G;
$X^5$ can be selected from D and E;
$X^6$ can be selected from V, L, F, and Y;
$X^7$ can be selected from I, V, and F;
$X^8$ can be selected from Q and D;
$X^9$ can be selected from an amino acid;
$X^{10}$ can be selected from an amino acid;
$X^{11}$ can be selected from an amino acid; and
$X^{12}$ can be selected from an amino acid.

An IL-2Rβ ligand can comprise an amino acid sequence selected from any one of SEQ ID NOS: 188-196:

| Sequence | |
|---|---|
| C V L L E H S S V G D I I C | SEQ ID NO: 188 |
| L C H V G D Y I Q D G I C M | SEQ ID NO: 189 |
| L C H V G D Y I Q D G I C M | SEQ ID NO: 190 |
| S C Q I G E L V D L T D C A | SEQ ID NO: 191 |
| S C Q I G E L V D L T D C A | SEQ ID NO: 192 |
| T C Q V G D F F D W L S C A | SEQ ID NO: 193 |
| T C Q V G D F F D W L S C A | SEQ ID NO: 194 |
| Y A C A E N V I D W L C T | SEQ ID NO: 195 |
| Y A C A E N V I D W L C T | SEQ ID NO: 196 |

An IL-2Rβ ligand provided by the present disclosure can comprise a truncated amino acid sequence of any one of SEQ ID NOS: 185-196.

An IL-2Rβ ligand provided by the present disclosure can comprise an amino acid sequence selected from any one of SEQ ID NOS: 185-196, or a truncated amino acid sequence of any one of SEQ ID NOS: 185-196, wherein the amino acid sequence can independently comprise from 1 to 4 glycines (G) (SEQ ID NO: 9615) on the N-terminus, on the C-terminus, or on both the N- and C-termini.

An IL-2Rβ ligand provided by the present disclosure can comprise an amino acid sequence selected from any one of SEQ ID NOS: 185-196, or a truncated amino acid sequence of any one of SEQ ID NOS: 185-196, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 185-196 or to a truncated amino acid sequence of any one of SEQ ID NOS: 185-196.

An IL-2Rβ ligand of any one of SEQ ID NOS: 185-196 can bind to the hIL-2Rβ subunit with an $IC_{50}$ of less than 10 μM as determined using phage ELISA competition assays.

An IL-2Rβ ligand of any one of SEQ ID NOS: 185-196, a truncated IL-2Rβ ligand of any one of SEQ ID NOS: 185-196, or a substituted IL-2Rβ ligand of any one of SEQ ID NOS: 185-196 can bind to the hIL-2Rβ subunit with an $IC_{50}$ of less than 100 μM or less than 10 μM as determined using phage ELISA competition assays.

An IL-2Rβ ligand of any one of SEQ ID NOS: 188-196 bind to the hIL-2Rβ subunit with an $IC_{50}$ of less than 100 μM.

An IL-2Rβ ligand can comprise the amino acid sequence of Formula (4) (SEQ ID NO: 197):

$$-X^1-X^2-X^3-X^4-X^5-X^6-X^7-X^8-X^9-X^{10}-X^{11}-X^{12}- \quad (4)$$

wherein,
$X^1$ can be selected from an amino acid;
$X^2$ can be selected from an amino acid;
$X^3$ can be selected from an amino acid comprising an acidic side chain;
$X^4$ can be selected from an amino acid comprising a large hydrophobic side chain;
$X^5$ can be selected from an amino acid comprising a small hydrophobic side chain;
$X^6$ can be selected from an amino acid comprising an acidic side chain;
$X^7$ can be selected from an amino acid comprising a large hydrophobic side chain;
$X^8$ can be selected from an amino acid;
$X^9$ can be selected from an amino acid comprising an acidic side chain;
$X^{10}$ can be selected from an amino acid;
$X^{11}$ can be selected from an amino acid; and
$X^{12}$ can be selected from an amino acid comprising a large hydrophobic side chain.
In IL-2Rβ ligands of Formula (4),
$X^1$ can be selected from an amino acid;
$X^2$ can be selected from an amino acid;
$X^3$ can be selected from D and E;
$X^4$ can be selected from I, L, M, V, F, Y, and W;
$X^5$ can be selected from A, G, P, S, and T;
$X^6$ can be selected from D and E;
$X^7$ can be selected from I, L, M, V, F, Y, and W;
$X^8$ can be selected from an amino acid;
$X^9$ can be selected from D and E;
$X^{10}$ can be selected from an amino acid;
$X^{11}$ can be selected from an amino acid; and
$X^{12}$ can be selected from I, L, M, V, F, Y, and W.
In IL-2Rβ ligands of Formula (4),
$X^1$ can be selected from C, F, L, S, and W;
$X^2$ can be selected from C, D, F, G, L, M, Q, S, V, W, and Y;
$X^3$ can be selected from A, C, D, E, L, M, N, S, W, and Y;
$X^4$ can be selected from A, D, I, M, V, and W;
$X^5$ can be selected from D, E, G, and I;
$X^6$ can be selected from C, D, G, H, L, Q, S, and T;
$X^7$ can be selected from C, D, I, L, V, W, and Y;
$X^8$ can be selected from C, D, L, V, and W;
$X^9$ can be selected from C, D, G, I, M, N, P, Q, and W;
$X^{10}$ can be selected from D. F. L. M. P, S, T, and Y;
$X^{11}$ can be selected from C, F, L, V, and W; and
$X^{12}$ can be selected from L, N, S, T, and V.
In IL-2Rβ ligands of Formula (4), X can be selected from C, F, L, S, and W.
In IL-2Rβ ligands of Formula (4), $X^2$ can be selected from C, D, F, G, L, M, Q, S, V, W, and Y.
In IL-2Rβ ligands of Formula (4), $X^3$ can be selected from D and E.
In IL-2Rβ ligands of Formula (4), $X^4$ can be V.
In IL-2Rβ ligands of Formula (4), $X^5$ can be G.
In IL-2Rβ ligands of Formula (4), $X^6$ can be D.
In IL-2Rβ ligands of Formula (4), $X^7$ can be selected from I, W, and Y.
In IL-2Rβ ligands of Formula (4), $X^8$ can be selected from C, D, L, V, and W.
In IL-2Rβ ligands of Formula (4), $X^9$ can be D.
In IL-2Rβ ligands of Formula (4), $X^{10}$ can be selected from D, F, L, M, P, S, T, and Y.
In IL-2Rβ ligands of Formula (4), $X^{11}$ can be selected from C, F, L, V, and W.
In IL-2Rβ ligands of Formula (4), $X^{12}$ can be selected from L and V.
In IL-2Rβ ligands of Formula (4), the IL-2Rβ ligand can be defined by any combination of $X^1$-$X^{12}$ as defined in the immediately preceding twelve (12) paragraphs.
In IL-2Rβ ligands of Formula (4),
$X^1$ can be selected from an amino acid;
$X^2$ can be selected from an amino acid;
$X^3$ can be selected from D and E;
$X^4$ can be V;
$X^5$ can be G;
$X^6$ can be D;
$X^7$ can be selected from I, Y, and W;
$X^8$ can be selected from an amino acid;
$X^9$ can be D;
$X^{10}$ can be selected from an amino acid;
$X^{11}$ can be selected from an amino acid; and
$X^{12}$ can be selected from I, L, M, V, F, Y, and W.
An IL-2Rβ ligand can comprise an amino acid sequence selected from any one of SEQ ID NOS: 198-212:

C Q S V G D W C D M     SEQ ID NO: 198

C D A V G S W C D F C     SEQ ID NO: 199

C F T V G D Y C G Y     SEQ ID NO: 200

C Y E V G D Y C Q S     SEQ ID NO: 201

C G M A I G D L C M     SEQ ID NO: 202

C L E V G C I W D M F V     SEQ ID NO: 203

C Y E V G D Y C Q S P L     SEQ ID NO: 204

D C M L Y E L C D I D V L     SEQ ID NO: 205

F C D M G T V W P D L S     SEQ ID NO: 206

F L V C D D H Y C W L W T     SEQ ID NO: 207

R W G D V G D L L M P F L     SEQ ID NO: 208

R W G D V G D L L M P L     SEQ ID NO: 209

S C C V G D I W D T F     SEQ ID NO: 210

W C S D I G Q Y C D Y     SEQ ID NO: 211

W E S W N V G D L V N L V N W     SEQ ID NO: 212

An IL-2Rβ ligand provided by the present disclosure can comprise a truncated amino acid sequence of any one of SEQ ID NOS: 197-212.
An IL-2Rβ ligand provided by the present disclosure can comprise an amino acid sequence selected from any one of SEQ ID NOS: 197-212, or a truncated amino acid sequence of any one of SEQ ID NOS: 197-212, wherein the amino acid sequence can independently comprise from 1 to 4 glycines (G) (SEQ ID NO: 9615) on the N-terminus, on the C-terminus, or on both the N- and C-termini.

An IL-2Rβ ligand provided by the present disclosure can comprise an amino acid sequence selected from any one of SEQ ID NOS: 197-212, or a truncated amino acid sequence of any one of SEQ ID NOS: 197-212, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 197-212 or to a truncated amino acid sequence of any one of SEQ ID NOS: 197-212.

An IL-2Rβ ligand of any one of SEQ ID NOS: 197-212 can bind to the hIL-2Rβ subunit with an $IC_{50}$ of less than 10 μM as determined using phage ELISA competition assays.

An IL-2Rβ ligand of any one of SEQ ID NOS: 197-212, a truncated IL-2Rβ ligand of any one of SEQ ID NOS: 197-212, or a substituted IL-2Rβ ligand of any one of SEQ ID NOS: 197-212 can bind to the hIL-2Rβ subunit with an $IC_{50}$ of less than 100 μM or less than 10 μM as determined using phage ELISA competition assays.

An IL-2Rβ ligand of any one of SEQ ID NOS: 198-212 bound to the hIL-2Rβ subunit with an $IC_{50}$ of less than 100 μM.

An IL-20 ligand can comprise an amino acid sequence selected from any one of SEQ ID NOS: 213-219:

```
                              SEQ ID NO: 213
A S C X W L V S F G R S V C L

SEQ ID NO: 214
C L S I G F R D I C F Y R V

SEQ ID NO: 215
D C M L Y E L C D I D V L

SEQ ID NO: 216
F L V C D D H Y C W L W T

SEQ ID NO: 217
I C Y Y S P S D N T T V C E

SEQ ID NO: 218
I C Y Y S P S D N T T V C E

SEQ ID NO: 219
R S C Y Y K R P R L W C S E
```

An IL-2Rβ ligand provided by the present disclosure can comprise a truncated amino acid sequence of any one of SEQ ID NOS: 213-219.

An IL-2Rβ ligand provided by the present disclosure can comprise an amino acid sequence selected from any one of SEQ ID NOS: 213-219, or a truncated amino acid sequence of any one of SEQ ID NOS: 213-219, wherein the amino acid sequence can independently comprise from 1 to 4 glycines (G) (SEQ ID NO: 9615) on the N-terminus, on the C-terminus, or on both the N- and C-termini.

An IL-2Rβ ligand provided by the present disclosure can comprise an amino acid sequence selected from any one of SEQ ID NOS: 213-219, or a truncated amino acid sequence of any one of SEQ ID NOS: 213-219, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NO: 213-219 or a truncated amino acid sequence of any one of SEQ ID NOS: 213-219.

An IL-2Rβ ligand of any one of SEQ ID NOS: 213-219 can bind to the hIL-2Rβ subunit with an $IC_{50}$ of less than 10 μM as determined using phage ELISA competition assays.

An IL-2Rβ ligand of anyone of SEQ ID NOS: 213-219, a truncated IL-2Rβ ligand of anyone of SEQ ID NOS: 213-219, or a substituted IL-2Rβ ligand of any one of SEQ ID NOS: 213-219 can bind to the hIL-2Rβ subunit with an $IC_{50}$ of less than 100 μM or less than 10 μM as determined using phage ELISA competition assays.

An IL-2Rβ ligand of any one of SEQ ID NOS: 213-219 bind to the hIL-2Rβ subunit with an $IC_{50}$ of less than 100 μM.

An IL-20 ligand can comprise an amino acid sequence of Formula (5) (SEQ ID NO: 220), an amino acid sequence of Formula (5a) (SEQ ID NO: 221), an amino acid sequence of Formula (5b) (SEQ ID NO: 222), an amino acid sequence of Formula (5c) (SEQ ID NO: 223), an amino acid sequence of Formula (5d) (SEQ ID NO: 224), an amino acid sequence of Formula (5e) (SEQ ID NO: 225), an amino acid sequence of Formula (5f) (SEQ ID NO: 226), or an amino acid sequence of Formula (5g) (SEQ ID NO: 227):

$$-X^1-X^2-X^3-X^4-X^5-C-X^6-X^7-X^8-X^9-X^{10}-X^{11}-X^{12}-X^{13}-C-X^{14}-X^{15}-X^{16}-X^{17}-X^{18}- \quad (5)$$

$$-X^2-X^3-X^4-X^5-C-X^6-X^7-X^8-X^9-X^{10}-X^{11}-X^{12}-X^{13}-C-X^{14}-X^{15}-X^{16}-X^{17}- \quad (5a)$$

$$-X^3-X^4-X^5-C-X^6-X^7-X^8-X^9-X^{10}-X^{11}-X^{12}-X^{13}-C-X^{14}-X^{15}-X^{16}- \quad (5b)$$

$$-X^4-X^5-C-X^6-X^7-X^8-X^9-X^{10}-X^{11}-X^{12}-X^{13}-C-X^{14}-X^{15}- \quad (5c)$$

$$-X^5-C-X^6-X^7-X^8-X^9-X^{10}-X^{11}-X^{12}-X^{13}-C-X^{14}- \quad (5d)$$

$$-C-X^6-X^7-X^8-X^9-X^{10}-X^{11}-X^{12}-X^{13}-C-X^{14}- \quad (5e)$$

$$-C-X^6-X^7-X^8-X^9-X^{10}-X^{11}-X^{12}-X^{13}-C- \quad (5f)$$

$$-X^6-X^7-X^8-X^9-X^{10}-X^{11}-X^{12}-X^{13}- \quad (5g)$$

wherein,
$X^1$ can be selected from an amino acid comprising a large hydrophobic side chain or an aromatic side chain;
$X^2$ can be selected from an amino acid;
$X^3$ can be selected from an amino acid comprising a large hydrophobic side chain or an aromatic side chain;
$X^4$ can be selected from an amino acid comprising a large hydrophobic side chain or a basic side chain;
$X^5$ can be selected from an amino acid comprising an acidic side chain or a small hydrophobic side chain;
$X^6$ can be selected from an amino acid comprising a large hydrophobic side chain or a basic side chain;
$X^7$ can be selected from an amino acid comprising a large hydrophobic side chain;
$X^8$ can be selected from an amino acid comprising a small hydrophobic side chain;
$X^9$ can be selected from an amino acid comprising a polar/neutral side chain or a basic side chain;
$X^{10}$ can be selected from an amino acid comprising a large hydrophobic side chain;

$X^{11}$ can be selected from an amino acid comprising a small hydrophobic side chain;
$X^1$ can be selected from an amino acid comprising an acidic side chain or a polar/neutral side chain;
$X^1$ can be selected from an amino acid comprising a large hydrophobic side chain;
$X^{14}$ can be selected from an amino acid comprising an acidic side chain;
$X^1$ can be selected from an amino acid comprising a large hydrophobic side chain;
$X^{16}$ can be selected from an amino acid comprising an acidic side chain or an aromatic side chain;
$X^{17}$ can be selected from an amino acid comprising an amino acid; and
$X^{18}$ can be selected from an amino acid comprising an acidic side chain.

In IL-2Rβ ligands of Formula (5)-(5g),
$X^1$ can be selected from F, H, I, L, M, V, W, and Y;
$X^2$ can be selected from an amino acid;
$X^3$ can be selected from F, H, I, L, M, V, W, and Y;
$X^4$ can be selected from F, I, L, M, V, W, Y, H, K, and R;
$X^5$ can be selected from D, E, A, G, P, S, and T;
$X^6$ can be selected from F, I, L, M, V, W, Y, H, K, and R;
$X^7$ can be selected from F, I, L, M, V, W, and Y;
$X^8$ can be selected from A, G, P, S, and T;
$X^9$ can be selected from H, N, Q, S, T, Y, H, K, and R;
$X^{10}$ can be selected from F, I, L, M, V, W, and Y;
$X^{11}$ can be selected from A, G, P, S, and T;
$X^{12}$ can be selected from D, E, H, N, Q, S, T, and Y;
$X^{13}$ can be selected from F, I, L, M, V, W, and Y;
$X^{14}$ can be selected from D and E;
$X^{15}$ can be selected from F, I, L, M, V, W, and Y;
$X^{16}$ can be selected from D, E, F, H, I, L, M, V, W, and Y;
$X^{17}$ can be selected from an amino acid; and
$X^{18}$ can be selected from D and E.

In IL-2Rβ ligands of Formula (5)-(5g), X can be selected from F, H, W, and Y.
In IL-2Rβ ligands of Formula (5)-(5g), $X^1$ can be W.
In IL-2Rβ ligands of Formula (5)-(5g), $X^2$ can be selected from an amino acid.
In IL-2Rβ ligands of Formula (5)-(5g), $X^3$ can be selected from F, H, W, and Y.
In IL-2Rβ ligands of Formula (5)-(5g), $X^3$ can be selected from F, W, and Y.
In IL-2Rβ ligands of Formula (5)-(5g), $X^4$ can be selected from H, L, and Y.
In IL-2Rβ ligands of Formula (5)-(5g), $X^4$ can be L.
In IL-2Rβ ligands of Formula (5)-(5g), $X^4$ can be Y.
In IL-2Rβ ligands of Formula (5)-(5g), $X^5$ can be selected from D and P.
In IL-2Rβ ligands of Formula (5)-(5g), $X^5$ can be D.
In IL-2Rβ ligands of Formula (5)-(5g), $X^5$ can be P.
In IL-2Rβ ligands of Formula (5)-(5g), $X^6$ can be selected from H and W.
In IL-2Rβ ligands of Formula (5)-(5g), $X^6$ can be H.
In IL-2Rβ ligands of Formula (5)-(5g), $X^6$ can be W.
In IL-2Rβ ligands of Formula (5)-(5g), $X^7$ can be M.
In IL-2Rβ ligands of Formula (5)-(5g), $X^8$ can be A.
In IL-2Rβ ligands of Formula (5)-(5g), $X^9$ can be selected from H, K, R, and Q.
In IL-2Rβ ligands of Formula (5)-(5g), $X^9$ can be Q.
In IL-2Rβ ligands of Formula (5)-(5g), $X^9$ can be selected from H, K, and R.

In IL-2Rβ ligands of Formula (5)-(5g), $X^{10}$ can be selected from L and V.
In IL-2Rβ ligands of Formula (5)-(5g), $X^{10}$ can be L.
In IL-2Rβ ligands of Formula (5)-(5g), $X^{11}$ can be G.
In IL-2Rβ ligands of Formula (5)-(5g), $X^{12}$ can be selected from D, E, and Q.
In IL-2Rβ ligands of Formula (5)-(5g), $X^{12}$ can be E.
In IL-2Rβ ligands of Formula (5)-(5g), $X^{13}$ can be L.
In IL-2Rβ ligands of Formula (5)-(5g), $X^{14}$ can be selected from D and E.
In IL-2Rβ ligands of Formula (5)-(5g), $X^{14}$ can be D.
In IL-2Rβ ligands of Formula (5)-(5g), $X^{15}$ can be L.
In IL-2Rβ ligands of Formula (5)-(5g), $X^{16}$ can be selected from D and E.
In IL-2Rβ ligands of Formula (5)-(5g), $X^{17}$ can be selected from an amino acid.
In IL-2Rβ ligands of Formula (5)-(5g), $X^{18}$ can be selected from D and E.

In IL-2Rβ ligands of Formula (5)-(5g), the IL-2Rβ ligand can be defined by any combination of $X^1$-$X^{18}$ as defined in the immediately preceding thirty one (31) paragraphs.

In IL-2Rβ ligands of Formula (5)-(5g),
$X^1$ can be selected from F, H, W, and Y;
$X^2$ can be selected from an amino acid;
$X^3$ can be selected from F, H, W, and Y;
$X^4$ can be selected from H, L, and Y;
$X^5$ can be selected from D and P;
$X^6$ can be selected from H, R, and W;
$X^7$ can be M;
$X^8$ can be A;
$X^9$ can be selected from H, K, R, and Q;
$X^{10}$ can be selected from L and V;
$X^{11}$ can be G;
$X^{12}$ can be selected from D, E, and Q;
$X^{13}$ can be L;
$X^{14}$ can be selected from D and E;
$X^{15}$ can be L;
$X^{16}$ can be selected from D, E, H, F, W, and Y;
$X^{17}$ can be selected from an amino acid; and
$X^{18}$ can be selected from D and E.

In IL-2Rβ ligands of Formula (5)-(5g),
$X^1$ can be selected from F, H, W, and Y;
$X^2$ can be selected from an amino acid;
$X^3$ can be Y;
$X^4$ can be selected from H, L, and Y;
$X^5$ can be D;
$X^6$ can be W;
$X^7$ can be M;
$X^8$ can be A;
$X^9$ can be Q;
$X^{10}$ can be selected from L and V;
$X^{11}$ can be G;
$X^{12}$ can be selected from D, E, and Q;
$X^{13}$ can be L;
$X^{14}$ can be selected from D and E;
$X^{15}$ can be L;
$X^{16}$ can be selected from D and E;
$X^{17}$ can be selected from an amino acid; and
$X^{18}$ can be selected from D and E.

In IL-2Rβ ligands of Formula (5)-(5g),
$X^1$ can be selected from F, H, W, and Y;
$X^2$ can be selected from an amino acid;
$X^3$ can be Y;
$X^4$ can be selected from H, L, and Y;
$X^5$ can be D;
$X^6$ can be H;
$X^7$ can be M;

X⁸ can be A;
X⁹ can be Q;
X¹⁰ can be selected from L and V;
X¹¹ can be G;
X¹² can be selected from D, E, and Q;
X¹³ can be L;
X¹⁴ can be selected from D and E;
X¹⁵ can be L;
X¹⁶ can be selected from D and E;
X¹⁷ can be selected from an amino acid; and
X¹⁸ can be selected from D and E.
In IL-2Rβ ligands of Formula (5)-(5g),
X¹ can be selected from F, H, W, and Y;
X² can be selected from an amino acid;
X³ can be Y;
X⁴ can be selected from H, L, and Y;
X⁵ can be D;
X⁶ can be R;
X⁷ can be M;
X⁸ can be A;
X⁹ can be Q;
X¹⁰ can be selected from L and V;
X¹¹ can be G;
X¹² can be selected from D, E, and Q;
X¹³ can be L;
X¹⁴ can be selected from D and E;
X¹⁵ can be L;
X¹⁶ can be selected from D and E;
X¹⁷ can be selected from an amino acid; and
X¹⁸ can be selected from D and E.
In IL-2Rβ ligands of Formula (5)-(5g),
X¹ can be selected from F, H, W, and Y;
X² can be selected from an amino acid;
X³ can be Y;
X⁴ can be selected from H, L, and Y;
X⁵ can be P;
X⁶ can be W;
X⁷ can be M;
X⁸ can be A;
X⁹ can be Q;
X¹⁰ can be selected from L and V;
X¹¹ can be G;
X¹² can be selected from D, E, and Q;
X¹³ can be L;
X¹⁴ can be selected from D and E;
X¹⁵ can be L;
X¹⁶ can be selected from D and E;
X¹⁷ can be selected from an amino acid; and
X¹⁸ can be selected from D and E.
In IL-2Rβ ligands of Formula (5)-(5g),
X¹ can be selected from F, H, W, and Y;
X² can be selected from an amino acid;
X³ can be Y;
X⁴ can be selected from H, L, and Y;
X⁵ can be D;
X⁶ can be W;
X⁷ can be M;
X⁸ can be A;
X⁹ can be selected from H, K, and R;
X¹⁰ can be selected from L and V;
X¹¹ can be G;
X¹² can be selected from D, E, and Q;
X¹³ can be L;
X¹⁴ can be selected from D and E;
X¹⁵ can be L;
X¹⁶ can be selected from D and E;

X¹⁷ can be selected from an amino acid; and
X¹⁸ can be selected from D and E.
In IL-2Rβ ligands of Formula (5)-(5g),
X¹ can be selected from F, H, W, and Y;
X² can be selected from an amino acid;
X³ can be Y;
X⁴ can be selected from H, L, and Y;
X⁵ can be D;
X⁶ can be W;
X⁷ can be M;
X⁸ can be A;
X⁹ can be Q;
X¹⁰ can be selected from L and V;
X¹¹ can be G;
X¹² can be selected from D, E, and Q;
X¹³ can be L;
X¹⁴ can be selected from D and E;
X¹⁵ can be L;
X¹⁶ can be selected from F, H, W, and Y;
X¹⁷ can be selected from an amino acid; and
X¹⁸ can be selected from D and E.
In IL-2Rβ ligands of Formula (5)-(5g),
X¹ can be selected from A, D, E, F, G, H, I, K, L, N, M, P, Q, R, S, T, V, W, and Y;
X² can be selected from A, D, E, F, G, H, I, K, L, M, N, P, Q, R, S, T, V, W, and Y;
X³ can be selected from A, C, D, F, G, H, I, L, M, N P, R, S, T, V, W, and Y;
X⁴ can be selected from F, H, I, K, L, N, P, Q, R, S, T, V, W, and Y;
X⁵ can be selected from A, D, E, F, G, H, K, L, M, N, P, Q, S, W, and Y;
X⁶ can be selected from A, E, F, G, H, Q, R, S, W, and Y;
X⁷ can be selected from A, D, E, F, I, K, L, M, N, Q, R, S, T, V, W, and Y;
X⁸ can be A;
X⁹ can be selected from A, D, H, K, L, N, P, Q, R, S, and Y;
X¹⁰ can be selected from I, L, M, P, and V;
X¹¹ can be selected from G, H, and W;
X¹² can be selected from D, E, and Q;
X¹³ can be L;
X¹⁴ can be selected from A, D, E, H, I, L, T, V, and Y;
X¹⁵ can be selected from F, I, L, M, V, W, and Y;
X¹⁶ can be selected from A, D, E, F, G, H, I, K, L, M, N, P, Q, R, S, T, V, W, and Y;
X¹⁷ can be selected from A, C, D, E, F, G, H, I, L, M, N, P, Q, R, S, T, V, W, and Y; and
X¹⁸ can be selected from A, D, E, F, G, H, K, L, M, N, P, Q, R, S, T, V, W, and Y.
In IL-2Rβ ligands of (5)-(5g),
X¹ can be selected from F, H, W, and Y;
X² can be selected from A, D, E, F, G, H, I, K, L, M, N, P, Q, R, S, T, V, W, and Y;
X³ can be selected from F, H, W, and Y;
X⁴ can be selected from F, H, I, L, V W, and Y;
X⁵ can be selected from D, E, and P;
X⁶ can be selected from F, H, R, S, W, and Y;
X⁷ can be selected from F, I, L, M, and V;
X⁸ can be A;
X⁹ can be selected from H, K, N, Q, and R;
X¹⁰ can be selected from I, L, and V;
X¹¹ can be G;
X¹² can be selected from D, E, and Q;
X¹³ can be selected from F, I, L, M, V, and Y;
X¹⁴ can be selected from D and E;
X¹⁵ can be L;

$X^{16}$ can be selected from D, E, N, and Q;
$X^{17}$ can be selected from A, D, E, F, G, H, I, L, M, N, P, Q, R, S, T, V, W, and Y; and
$X^{18}$ can be selected from D and E.

In IL-2Rβ ligands of Formula (5)-(5g),
$X^1$ can be W;
$X^2$ can be selected from A, D, E, F, G, H, I, K, L, M, N, P, Q, R, S, T, V, W, and Y;
$X^3$ can be selected from F, H, W, and Y;
$X^4$ can be Y;
$X^5$ can be selected from D, E, and P;
$X^6$ can be selected from H, R, and W;
$X^7$ can be selected from I and M;
$X^8$ can be A;
$X^9$ can be selected from K, Q, and R;
$X^{10}$ can be selected from I, L, and V;
$X^{11}$ can be G;
$X^{12}$ can be E;
$X^{13}$ can be L;
$X^{14}$ can be D;
$X^{15}$ can be L;
$X^{16}$ can be selected from D and E;
$X^{17}$ can be selected from A, D, E, F, G, H, I, L, M, N, P, Q, R, S, T, V, W, and Y; and
$X^{18}$ can be selected from D and E.

In IL-2Rβ ligands of Formula (5)-(5g),
$X^1$ can be selected from A, D, E, F, G, H, I, K, L, N, M, P, Q, R, S, T, V, W, and Y;
$X^2$ can be selected from A, D, E, F, G, H, I, K, L, M, N, P, Q, R, S, T, V, W, and Y;
$X^3$ can be selected from F, H, W, and Y;
$X^4$ can be selected from F, H, L, W, and Y;
$X^5$ can be selected from D, E, and P;
$X^6$ can be selected from F, H, R, S, W, and Y;
$X^7$ can be selected from F, I, L, M, and V;
$X^8$ can be A;
$X^9$ can be selected from H, K, Q, N, and R;
$X^{10}$ can be selected from I, L, and V;
$X^{11}$ can be G;
$X^{12}$ can be selected from D, E, and Q;
$X^{13}$ can be L;
$X^{14}$ can be selected from D and E;
$X^{15}$ can be selected from F, I, L, M, V, and W;
$X^{16}$ can be selected from D, E, F, I, L, M, V, W, and Y;
$X^{17}$ can be selected from A, D, E, F, G, H, I, L, M, N, P, Q, R, S, T, V, W, and Y; and
$X^{18}$ can be selected from D and E.

In IL-2Rβ ligands of Formula (5)-(5g), $X^1$ can be selected from A, D, E, F, G, H, I, K, L, N, M, P, Q, R, S, T, V, W, and Y.
In IL-2Rβ ligands of Formula (5)-(5g), $X^1$ can be selected from A, G, P, S, and T.
In IL-2Rβ ligands of Formula (5)-(5g), $X^1$ can be selected from F, H, I, L, M, V, W, and Y.
In IL-2Rβ ligands of Formula (5)-(5g), $X^1$ can be selected from F, H, W, and Y.
In IL-2Rβ ligands of Formula (5)-(5g), $X^2$ can be selected from A, D, E, F, G, H, I, K, L, M, N, P, Q, R, S, T, V, W, and Y.
In IL-2Rβ ligands of Formula (5)-(5g), $X^2$ can be selected from A, G, P, S, and T.
In IL-2Rβ ligands of Formula (5)-(5g), $X^2$ can be selected from F, H, I, L, M, V, W, and Y.
In IL-2Rβ ligands of Formula (5)-(5g), $X^3$ can be selected from F, H, W, and Y.
In IL-2Rβ ligands of Formula (5)-(5g), $X^3$ can be W.
In IL-2Rβ ligands of Formula (5)-(5g), $X^4$ can be selected from F, H, L, W, and Y.
In IL-2Rβ ligands of Formula (5)-(5g), $X^4$ can be selected from H, L, and Y.
In IL-2Rβ ligands of Formula (5)-(5g), $X^4$ can be Y.
In IL-2Rβ ligands of Formula (5)-(5g), $X^5$ can be selected from D, E, and P.
In IL-2Rβ ligands of Formula (5)-(5g), $X^5$ can be D.
In IL-2Rβ ligands of Formula (5)-(5g), $X^5$ can be P.
In IL-2Rβ ligands of Formula (5)-(5g), $X^6$ can be selected from F, H, R, S, W, and Y.
In IL-2Rβ ligands of Formula (5)-(5g), $X^6$ can be selected from H, R, and W.
In IL-2Rβ ligands of Formula (5)-(5g), $X^6$ can be W.
In IL-2Rβ ligands of Formula (5)-(5g), $X^7$ can be selected from F, I, L, M, and V.
In IL-2Rβ ligands of Formula (5)-(5g), $X^7$ can be selected from I and M.
In IL-2Rβ ligands of Formula (5)-(5g), $X^7$ can be M.
In IL-2Rβ ligands of Formula (5)-(5g), $X^8$ can be A.
In IL-2Rβ ligands of Formula (5)-(5g), $X^9$ can be selected from H, K, Q, N, and R.
In IL-2Rβ ligands of Formula (5)-(5g), $X^9$ can be selected from H, K, and R.
In IL-2Rβ ligands of Formula (5)-(5g), $X^9$ can be Q.
In IL-2Rβ ligands of Formula (5)-(5g), $X^{10}$ can be selected from I, L, and V.
In IL-2Rβ ligands of Formula (5)-(5g), $X^{10}$ can be selected from L and V.
In IL-2Rβ ligands of Formula (5)-(5g), $X^{11}$ can be G.
In IL-2Rβ ligands of Formula (5)-(5g), $X^{12}$ can be selected from D, E, and Q.
In IL-2Rβ ligands of Formula (5)-(5g), $X^{12}$ can be E.
In IL-2Rβ ligands of Formula (5)-(5g), $X^{13}$ can be L.
In IL-2Rβ ligands of Formula (5)-(5g), $X^{14}$ can be selected from D and E.
In IL-2Rβ ligands of Formula (5)-(5g), $X^{14}$ can be D.
In IL-2Rβ ligands of Formula (5)-(5g), $X^{15}$ can be selected from F, I, L, M, V, and W.
In IL-2Rβ ligands of Formula (5)-(5g), $X^{15}$ can be L.
In IL-2Rβ ligands of Formula (5)-(5g), $X^{16}$ can be selected from D and E.
In IL-2Rβ ligands of Formula (5)-(5g), $X^{16}$ can be D.
In IL-2Rβ ligands of Formula (5)-(5g), $X^{16}$ can be selected from F, I, L, M, V, W, and Y.
In IL-2Rβ ligands of Formula (5)-(5g), $X^{17}$ can be selected from A, D, E, F, G, H, I, L, M, N, P, Q, R, S, T, V, W, and Y.
In IL-2Rβ ligands of Formula (5)-(5g), $X^{17}$ can be selected from A, G, P, S, and T.
In IL-2Rβ ligands of Formula (5)-(5g), $X^{17}$ can be selected from F, I, L, M, V, W, and Y.
In IL-2Rβ ligands of Formula (5)-(5g), $X^{18}$ can be selected from D and E.

In IL-2Rβ ligands of Formula (5)-(5g), the IL-2Rβ ligand can be defined by any combination of $X^1$-$X^{18}$ as defined in the immediately preceding forty two (42) paragraphs.

In IL-2Rβ ligands of Formula (5)-(5g),
$X^1$ can be selected from F, I, L, M, V, W, and Y;
$X^2$ can be selected from A, D, E, F, G, H, I, K, L, M, N, P, Q, R, S, T, V, W, and Y;
$X^3$ can be selected from F, H, W, and Y;
$X^4$ can be selected from H, L, and Y;
$X^5$ can be selected from D and P;

$X^6$ can be selected from H, R, and W;
$X^7$ can be selected from I and M;
$X^8$ can be A;
$X^9$ can be selected from H, K, Q, and R;
$X^{10}$ can be selected from L and V;
$X^{11}$ can be G;
$X^{12}$ can be selected from D, E, and Q;
$X^{13}$ can be L;
$X^{14}$ can be selected from D and E;
$X^{15}$ can be L;
$X^{16}$ can be selected from D, E, F, I, L, M, V, W, and Y;
$X^{17}$ can be selected from A, D, E, F, G, H, I, L, M, N, P, Q, R, S, T, V, W, and Y; and
$X^{18}$ can be selected from D and E.

In IL-2Rβ ligands of Formula (5)-(5g),
$X^1$ can be selected from F, I, L, M, V, W, and Y;
$X^2$ can be selected from A, D, E, F, G, H, I, K, L, M, N, P, Q, R, S, T, V, W, and Y;
$X^3$ can be W;
$X^4$ can be Y;
$X^5$ can be selected from D and P;
$X^6$ can be W;
$X^7$ can be M;
$X^8$ can be A;
$X^9$ can be Q;
$X^9$ can be selected from H, K, and R;
$X^{10}$ can be selected from L and V;
$X^{11}$ can be G;
$X^{12}$ can be E;
$X^{13}$ can be L;
$X^{14}$ can be selected from D and E;
$X^{15}$ can be L;
$X^{16}$ can be D;
$X^{17}$ can be selected from A, D, E, F, G, H, I, L, M, N, P, Q, R, S, T, V, W, and Y; and
$X^{18}$ can be selected from D and E.

In IL-2Rβ ligands of Formula (5)-(5g),
$X^1$ can be selected from F, I, L, M, V, W, and Y;
$X^2$ can be selected from A, D, E, F, G, H, I, K, L, M, N, P, Q, R, S, T, V, W, and Y;
$X^3$ can be W;
$X^4$ can be Y;
$X^5$ can be selected from D and P;
$X^6$ can be selected from H, R, and W;
$X^7$ can be M;
$X^8$ can be A;
$X^9$ can be selected from H, K, Q, and R;
$X^{10}$ can be selected from L and V;
$X^{11}$ can be G;
$X^{12}$ can be E;
$X^{13}$ can be L;
$X^{14}$ can be D;
$X^{15}$ can be L;
$X^{16}$ can be D;
$X^{17}$ can be selected from A, D, E, F, G, H, I, L, M, N, P, Q, R, S, T, V, W, and Y; and
$X^{18}$ can be selected from D and E.

An IL-2Rβ ligand can comprise an amino acid sequence selected from any one of SEQ ID NOS: 228-457:

```
AQARFWHDCSIAHVGELCDL                    SEQ ID NO: 228

AVRNVWYDCSFARLHELCDV                    SEQ ID NO: 229

AGWHPCHLAQVGELCDLDAL                    SEQ ID NO: 230

AEVKPCHMAQVGDLCDLTGG                    SEQ ID NO: 231

AVWYDCRIAQVGELCDLVHP                    SEQ ID NO: 232

AYRAMPYYCWMAQLGELCDL                    SEQ ID NO: 233

ANFYDCRYAQLGELCDLMNV                    SEQ ID NO: 234

ALSWLWQDCALAQLGELCDL                    SEQ ID NO: 235

DV

```
GWHHWCHMAQVGELCDLQVT              SEQ ID NO: 257
GLTLPCWMAQLGELCDLNNA              SEQ ID NO: 258
GNFKQCHMAAVGELCEMENE              SEQ ID NO: 259
GGMAKYNPCHIAKLGELCDL              SEQ ID NO: 260
GVTYQWYDCSIALVGELCDI              SEQ ID NO: 261
GSSVEIKPCWMAYLGELCHL              SEQ ID NO: 262
GVFYDCRIAQLGELCDLWAS              SEQ ID NO: 263
GFSHFCWEAQVGELCDLIYG              SEQ ID NO: 264
GEWYDCRIAQVGELCDLWPV              SEQ ID NO: 265
GDLVMFYDCRFARVGELCDL              SEQ ID NO: 266
GSVWEFYDCFIARVGELCDL              SEQ ID NO: 267
HPCWMAKVGELCDL                    SEQ ID NO: 268
HPCHMARLGELCDLHSGVYD              SEQ ID NO: 269
HMFYPCWRAQVGELCDLANY              SEQ ID NO: 270
HWCWMARLGELCDL                    SEQ ID NO: 271
HIMRTWYDCSIAQIGELCDL              SEQ ID NO: 272
HPCHMAQVGELCDLNFPYVE              SEQ ID NO: 273
IYCGFAPLGELCIL                    SEQ ID NO: 274
INQSVLWPCHLAAVGDLCDL              SEQ ID NO: 275
IGYHACWMAQLGDLCDLHDN              SEQ ID NO: 276
IKMSPCHLAQVGELCDLQWE              SEQ ID NO: 277
ISGLGIYPCWMAHLGELCDL              SEQ ID NO: 278
KLGKGWHDCSVAQVGELCDL              SEQ ID NO: 279
KVKLSWYDCSVAQVGELCDL              SEQ ID NO: 280
KWCWLAHLGELCDL                    SEQ ID NO: 281
KSGQRYYDCSMAQLGELCDL              SEQ ID NO: 282
KPCYMAQVGELCDLPAESLS              SEQ ID NO: 283
KACHMAQLGELCDLYQGGIN              SEQ ID NO: 284
KTWYDCRFAQLGELCDLNMN              SEQ ID NO: 285
KVWYPCRIAQVGELCDLDQF              SEQ ID NO: 286
KYCGFAQLGELCVL                    SEQ ID NO: 287
LPCWIAQVGELCDL                    SEQ ID NO: 288
LPCHMAQLGELCDL                    SEQ ID NO: 289
LVGWNHYDCSVARVGELCDL              SEQ ID NO: 290
LYCWQAQLGQLCDL                    SEQ ID NO: 291
LMCWNAQLGDLCDL                    SEQ ID NO: 292
LEYDWNQACSKAHLGELCVL              SEQ ID NO: 293
LACRFAKLGELCDL                    SEQ ID NO: 294
LPCWMAQLGDLCDL                    SEQ ID NO: 295
LYRPNYSDCSMAQLGELCEM              SEQ ID NO: 296
LYCWAAQLGELCDL                    SEQ ID NO: 297
LACWMAHLGDLCDL                    SEQ ID NO: 298
LPCWLAKVGDLCDL                    SEQ ID NO: 299
LPRSGWYDCSIAHVGELCDL              SEQ ID NO: 300
LSVNKWYPCWIADVGELCDW              SEQ ID NO: 301
LKCWMAQLGELCDL                    SEQ ID NO: 302
LDCRFAQVGDLCDI                    SEQ ID NO: 303
LWCWMAQLGELCDL                    SEQ ID NO: 304
LDETYWDCHVAQVGELCDL               SEQ ID NO: 305
LMCWLAQLGELCEL                    SEQ ID NO: 306
LHCHNAQVGDLCDL                    SEQ ID NO: 307
LWCHMANLGDLCDL                    SEQ ID NO: 308
LMVWDRRDCSTAQLGELCDL              SEQ ID NO: 309
LPCWLANVGELCDLPGKFER              SEQ ID NO: 310
```

LKCWMAQVGELCDLGVDDGQ (SEQ ID NO: 311)

LGCWLAHVGELCDLMFPGDE (SEQ ID NO: 312)

LPCWMAQVGQLCYLDTERHS (SEQ ID NO: 313)

LYCGFAQVGDLCDLDVEVTY (SEQ ID NO: 314)

LPCWKAYVGELCDLNMPRLD (SEQ ID NO: 315)

LDWHACWEAQVGELCDLRRS (SEQ ID NO: 316)

LWCHMANVGELCDIDWTNGS (SEQ ID NO: 317)

LACHVAQLGELCDLWPDGVN (SEQ ID NO: 318)

LHCYDAQVGELCDLENWLHQ (SEQ ID NO: 319)

LPCWLAQVGELCDLQEETGS (SEQ ID NO: 320)

LPCHLAQVGELCDLPSSMLT (SEQ ID NO: 321)

LWFYDCRFAHVGELCDLEQT (SEQ ID NO: 322)

LHILKNYPCYLAQVGELCDL (SEQ ID NO: 323)

LPCHMALLGQLCDL (SEQ ID NO: 324)

LMCWFAQLGDLCDL (SEQ ID NO: 325)

LWCWMAQVGELCDLEERSFM (SEQ ID NO: 326)

LPCWKANLGELCDLYDMGHS (SEQ ID NO: 327)

LPCWLARLGELCDLQYEYND (SEQ ID NO: 328)

LYCWMAQLGELCDLEHVDWN (SEQ ID NO: 329)

LWCGIAQLGELCDLELGIHD (SEQ ID NO: 330)

LLCWMAQLGELCDLEGEVMK (SEQ ID NO: 331)

LYCGMAHVGQLCILEDWRGA (SEQ ID NO: 332)

MENKYWYDCSVALVGELCDL (SEQ ID NO: 333)

MSWYDCWMAQVGELCDLHVL (SEQ ID NO: 334)

MGFYPCWTAQLGELCDLSVD (SEQ ID NO: 335)

NLHYDCRIAQVGELCDLTYE (SEQ ID NO: 336)

NEQMIPWPCHLAQLGDLCDL (SEQ ID NO: 337)

PSSRGYKPCWSAQVGELCEL (SEQ ID NO: 338)

PLCYSCQMARVGELCDLGCD (SEQ ID NO: 339)

PEWYDCSTAQVGELCDLFDD (SEQ ID NO: 340)

PIYQPCHMAALGELCDLGTA (SEQ ID NO: 341)

PAYYDCSIAKVGELCDLSMM (SEQ ID NO: 342)

PERGGWYDCRFAKLGELCDL (SEQ ID NO: 343)

PLNYPCWIAQLGELCDLDLR (SEQ ID NO: 344)

QVEGSYYDCRWAHLGELCDL (SEQ ID NO: 345)

QWCWMARLGELCDL (SEQ ID NO: 346)

QVHYDCSMAQLGELCDLYDE (SEQ ID NO: 347)

QFWLGCWMAQVGELCDLDQP (SEQ ID NO: 348)

RILYEYPDCWMAQLGELCEL (SEQ ID NO: 349)

RALRKFHDCSTARLGELCDL (SEQ ID NO: 350)

RSLFLWHDCSTAQLGELCDL (SEQ ID NO: 351)

RTYDPGQDCRLAQLGELCEL (SEQ ID NO: 352)

RGRWEWYDCSIAQVGELCDV (SEQ ID NO: 353)

RSFENWYDCRIAQLGELCDL (SEQ ID NO: 354)

RKTWIWKDCSIARVGELCDL (SEQ ID NO: 355)

RHFLDCRIAQIGDLCDLIGF (SEQ ID NO: 356)

RWCHMAQLGDLCELYIFDKH (SEQ ID NO: 357)

RPWRQWYDCSIARLGELCDI (SEQ ID NO: 358)

RRASWCHLAQVGELCDLLWE (SEQ ID NO: 359)

RLFDPDQNCRFALLGELCLL (SEQ ID NO: 360)

SGSNDVPHCSMADLGDLCHL (SEQ ID NO: 361)

SSYDMDQDCRWAQLGQLCAI (SEQ ID NO: 362)

SSYYSCSMAQLGELCDLKLS (SEQ ID NO: 363)

SKFYDCRIAKLGELCDLRSG (SEQ ID NO: 364)

SEQ ID NO: 365
S F V Q D C S L A Q L W D L C E I W T D

SEQ ID NO: 366
S G W Y P C R I A R L G E L C D L W E G

SEQ ID NO: 367
S V L L S Y P L C R F A Q L G E L C D L

SEQ ID NO: 368
S D L M V W K P C W T A Q L G E L C D L

SEQ ID NO: 369
T M A S N W Y D C H M A Q V G E L C D L

SEQ ID NO: 370
T A A E Y W Y P C W M A Q V G E L C D L

SEQ ID NO: 371
T S L D S Y Y D C G M A K V G E L C D L

SEQ ID NO: 372
T R N E F V Y P C W L A Q V G E L C D L

SEQ ID NO: 373
T P H Y P C W M A H M G E L C D L E W K

SEQ ID NO: 374
T S F H D C R I A N V G E L C D L S I L

SEQ ID NO: 375
T P C Y M A K L G E L C D L E E W A L E

SEQ ID NO: 376
V D V S G W K P C Y M A H L G E L C D L

SEQ ID NO: 377
V E T T A W Y P C E L A Q L G E L C D L

SEQ ID NO: 378
V Q Y K K C W M A Q L G D L C E L D P S

SEQ ID NO: 379
V R F H D C S I A L V G D L C D L H M Y

SEQ ID NO: 380
V T P Y Y C W N A K L G E L C D M M W N

SEQ ID NO: 381
V S W Y P C H M A Q V G E L C D L G F S

SEQ ID NO: 382
V G R Q M R K A C H M A L L G E L C D L

SEQ ID NO: 383
V S V W K D C S I A Q L G E L C D L

SEQ ID NO: 384
V S W V D C H M A Q V G E L C D L R D S

SEQ ID NO: 385
W H Q W L R K D C R F A K L G E L C D L

SEQ ID NO: 386
W S S K V V K P C H I A R L G E L C E L

SEQ ID NO: 387
W S W Y D C R I A Q I G E L C D L I I M

SEQ ID NO: 388
W L F Y D C R W A Q V G E L C D L S G D

SEQ ID NO: 389
W L Y P E C R F A Q V G Q L C E F R N Q

SEQ ID NO: 390
W P W Q D C S T A Q L G D L C D L M S Y

SEQ ID NO: 391
W A W L D C H N A Q V G E L C D L L R D

SEQ ID NO: 392
W S I A N F Y D C R F A H L G E L C D L

SEQ ID NO: 393
W A F Y D C F T A Q V G E L C D L S I G

SEQ ID NO: 394
W K F Q D C R T A Q V G E L C D L W P Y

SEQ ID NO: 395
W Y P C W M A Q L G E L C D L D

SEQ ID NO: 396
Y P C H M A N V G E L C D L

SEQ ID NO: 397
Y P C W M A Q I G E L C D L

SEQ ID NO: 398
Y P C H I A L L G E L C D L

SEQ ID NO: 399
Y D C R F A Q L G E L C D L

SEQ ID NO: 400
Y F C H I A K L G E L C D L

SEQ ID NO: 401
Y P C R M A K L G E L C D L

SEQ ID NO: 402
Y P C W L A H V G E L C D L

SEQ ID NO: 403
Y P C W M A Q L G E L C D L

SEQ ID NO: 404
Y D C S I A Q L G E L C D L

SEQ ID NO: 405
Y D S R S Y L P C H M A Q L G D L C D L

SEQ ID NO: 406
Y P C W M A L V G E L C D L

SEQ ID NO: 407
Y D C R F A L L G E L C D L

SEQ ID NO: 408
Y W C W M A Q L G E L C D L

SEQ ID NO: 409
Y P C W I A Q V G E L C D L

SEQ ID NO: 410
Y P C W V A K L G E L C D F

SEQ ID NO: 411
Y P C W I A K V G E L C D L

SEQ ID NO: 412
Y W C W M A Q V G E L C D L

SEQ ID NO: 413
Y E C H L A K L G E L C D L

SEQ ID NO: 414
Y P C H I A Q V G E L C D L

SEQ ID NO: 415
Y P C H V A Q L G E L C D L

SEQ ID NO: 416
Y D C S M A Q L G E L C D L

SEQ ID NO: 417
Y D C R I A Q V G E L C D L

SEQ ID NO: 418
Y P C H M A Q L G E L C D L W S W G D I

-continued

SEQ ID NO: 419
Y D C R N A H V G E L C D L I D V P W E

SEQ ID NO: 420
Y E C W M A K L G E L C D M Y L E G E I

SEQ ID NO: 421
Y L C R F A Q L G E L C D L H V H W E D

SEQ ID NO: 422
Y Y C G I A N V G E L C D L E M G G N I

SEQ ID NO: 423
Y H C R F A Q V G E L C D L E P Q I T W

SEQ ID NO: 424
Y P C W I A Q I G E L C D M D P R A N M

SEQ ID NO: 425
Y D C R F A Q L G E L C D L Y E T D G R

SEQ ID NO: 426
Y W C R F A Q V G E L C D V Q M Y A S Q

SEQ ID NO: 427
Y A C Y I A K L G E L C D L E M T D H G

SEQ ID NO: 428
Y A C W L A K V G E L C D M D E D F T I

SEQ ID NO: 429
Y S C G I A K V G E L C D L V D Q E P D

SEQ ID NO: 430
Y D C S I A Q L G E L C D V E P W E S M

SEQ ID NO: 431
Y W C R W A Q V G E L C D L E V E N K D

SEQ ID NO: 432
Y D C R M A K V G E L C D L W W D T L Y

SEQ ID NO: 433
Y D C H M A K L G E L C D L M L G D V T

SEQ ID NO: 434
Y P C H L A H V G E L C D L E G G T E F

SEQ ID NO: 435
Y D C S I A R V G E L C D L L Q D W W P

SEQ ID NO: 436
Y H C F L A Q V G D L C D L W D S M T T

SEQ ID NO: 437
Y D C F F A H V G E L C D L M G N S G T

SEQ ID NO: 438
Y P C W L A L P G E L C D L M E S T V N

SEQ ID NO: 439
Y D C S L A Q L G E L C D L T G P S Y G

SEQ ID NO: 440
Y P C H V A Q V G E L C D L S P G L H G

SEQ ID NO: 441
Y F C W M A K L G E L C D L

SEQ ID NO: 442
Y F C W M A Q L G E L C D L

SEQ ID NO: 443
Y P C H L A L L G E L C D L

SEQ ID NO: 444
Y P C W M A Q V G E L C D L

SEQ ID NO: 445
Y D C S I A K L G E L C D L

-continued

SEQ ID NO: 446
Y W C H I A Q L G E L C D L

SEQ ID NO: 447
Y P C W I A K L G E L C D F

SEQ ID NO: 448
Y P C W L A R V G E L C D L D S G D V H

SEQ ID NO: 449
Y D C S M A L L G E L C D L W M P A I K

SEQ ID NO: 450
Y P C W M A H V G E L C D L E G W F G V

SEQ ID NO: 451
Y K F L P C W R A R V G E L C D L D T A

SEQ ID NO: 452
Y P C H M A Q L G E L C D L W S W G D I

SEQ ID NO: 453
Y P C R I A K L G E L C D L S E W Q Q L

SEQ ID NO: 454
Y A C W F A Q V G E L C D L E E D M V T

SEQ ID NO: 455
Y P C W F A K L G E L C D L G L T D T K

SEQ ID NO: 456
Y T W L D C S V A Q L G Q L C D L W S M

SEQ ID NO: 457
Y P C W M A Q V G E L C D L F L E S V P

An IL-2Rβ ligand provided by the present disclosure can comprise a truncated amino acid sequence of any one of SEQ ID NOS: 220-457.

An IL-2Rβ ligand provided by the present disclosure can comprise an amino acid sequence selected from any one of SEQ ID NOS: 220-457, or a truncated amino acid sequence of any one of SEQ ID NOS: 220-457, wherein the amino acid sequence can independently comprise from 1 to 4 glycines (G) (SEQ ID NO: 9615) on the N-terminus, on the C-terminus, or on both the N- and C-termini.

An IL-2Rβ ligand provided by the present disclosure can comprise an amino acid sequence selected from any one of SEQ ID NOS: 220-457, or a truncated amino acid sequence of any one of SEQ ID NOS: 220-457, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 220-457 or a truncated amino acid sequence of any one of SEQ ID NOS: 220-457.

An IL-2Rβ ligand of any one of SEQ ID NOS: 220-457 can bind to the hIL-2Rβ subunit with an $IC_{50}$ of less than 10 µM as determined using phage ELISA competition assays.

An IL-2Rβ ligand of any one of SEQ ID NOS: 220-457, a truncated IL-2Rβ ligand of any one of SEQ ID NOS: 220-457, or a substituted IL-2Rβ ligand of any one of SEQ ID NOS: 220-457 can bind to the hIL-2Rβ subunit with an $IC_{50}$ of less than 100 µM or less than 10 µM as determined using phage ELISA competition assays.

An IL-2Rβ ligand of anyone of SEQ ID NOS: 228-457 binds to the hIL-2Rβ subunit with an $IC_{50}$ of less than 100 µM.

An IL-20 ligand can comprise an amino acid sequence of Formula (6) (SEQ ID NO: 458), an amino acid sequence of Formula (6a) (SEQ ID NO: 459), an amino acid sequence of Formula (6b) (SEQ ID NO: 460), an amino acid sequence of Formula (6c) (SEQ ID NO: 461), an amino acid sequence of Formula (6d) (SEQ ID NO: 462), or an amino acid sequence of Formula (6e) (SEQ ID NO: 463):

$$-X^1-X^2-X^3-X^4-C-X^5-X^6-X^7-X^8-X^9-X^{10}-X^{11}-X^{12}-C-X^{13}-X^{14}-X^{15}- \quad (6)$$

$$-X^2-X^3-X^4-C-X^5-X^6-X^7-X^8-X^9-X^{10}-X^{11}-X^{12}-C-X^{13}-X^{14}-X^{15}- \quad (6a)$$

$$-X^3-X^4-C-X^5-X^6-X^7-X^8-X^9-X^{10}-X^{11}-X^{12}-C-X^{13}-X^{14}- \quad (6b)$$

$$-X^4-C-X^5-X^6-X^7-X^8-X^9-X^{10}-X^{11}-X^{12}-C-X^{13}- \quad (6c)$$

$$-C-X^5-X^6-X^7-X^8-X^9-X^{10}-X^{11}-X^{12}-C- \quad (6d)$$

$$-X^5-X^6-X^7-X^8-X^9-X^{10}-X^{11}-X^{12}- \quad (6e)$$

wherein,
$X^1$ can be selected from an amino acid;
$X^2$ can be selected from an amino acid comprising an aromatic side chain;
$X^3$ can be selected from an amino acid comprising a large hydrophobic side chain or an aromatic side chain;
$X^4$ can be P;
$X^5$ can be selected from an amino acid comprising an aromatic side chain;
$X^6$ can be selected from an amino acid comprising a large hydrophobic side chain;
$X^7$ can be A;
$X^8$ can be selected from an amino acid comprising a basic side chain or a polar/neutral side chain;
$X^9$ can be selected from an amino acid comprising a large hydrophobic side chain;
$X^{10}$ can be G;
$X^{11}$ can be selected from an amino acid comprising an acidic side chain or a polar/neutral side chain;
$X^{12}$ can be L;
$X^{13}$ can be D;
$X^{14}$ can be selected from an amino acid comprising a large hydrophobic side chain; and
$X^{15}$ can be selected from an amino acid comprising an acidic side chain.
In IL-2Rβ ligands of Formula (6)-(6e),
$X^1$ can be selected from an amino acid;
$X^2$ can be selected from F, H, W, and Y;
$X^3$ can be selected from F, H, I, L, M, V, W, and Y;
$X^4$ can be P;
$X^5$ can be selected from F, H, W, and Y;
$X^6$ can be selected from F, I, L, M, V, W, and Y;
$X^7$ can be A;
$X^8$ can be selected from K, R, H, N, Q, S, T, and Y;
$X^9$ can be selected from F, I, L, M, V, W, and Y;
$X^{10}$ can be G;
$X^{11}$ can be selected from D, E, H, N, Q, S, T, and Y;
$X^{12}$ can be L;
$X^{13}$ can be D;
$X^{14}$ can be selected from F, I, L, M, V, W, and Y; and
$X^{15}$ can be selected from D and E.

In IL-2Rβ ligands of Formula (6)-(6e), $X^1$ can be selected from an amino acid.

In IL-2Rβ ligands of Formula (6)-(6e), $X^1$ can be selected from H, K, and R.

In IL-2Rβ ligands of Formula (6)-(6e), $X^1$ can be selected from H and R.

In IL-2Rβ ligands of Formula (6)-(6e), $X^2$ can be selected from F, H, W, and Y.

In IL-2Rβ ligands of Formula (6)-(6e), $X^2$ can be W.

In IL-2Rβ ligands of Formula (6)-(6e), $X^3$ can be selected from F, H, I, L, M, V, W, and Y.

In IL-2Rβ ligands of Formula (6)-(6e), $X^3$ can be L.

In IL-2Rβ ligands of Formula (6)-(6e), $X^3$ can be Y.

In IL-2Rβ ligands of Formula (6)-(6e), $X^4$ can be P.

In IL-2Rβ ligands of Formula (6)-(6e), $X^5$ can be selected from F, H, W, and Y.

In IL-2Rβ ligands of Formula (6)-(6e), $X^5$ can be W.

In IL-2Rβ ligands of Formula (6)-(6e), $X^6$ can be selected from F, I, L, M, V, W, and Y.

In IL-2Rβ ligands of Formula (6)-(6e), $X^6$ can be M.

In IL-2Rβ ligands of Formula (6)-(6e), $X^7$ can be A.

In IL-2Rβ ligands of Formula (6)-(6e), X can be selected from K, R, H, N, Q, S, T, and Y.

In IL-2Rβ ligands of Formula (6)-(6e), $X^8$ can be selected from K and R.

In IL-2Rβ ligands of Formula (6)-(6e), $X^8$ can be Q.

In IL-2Rβ ligands of Formula (6)-(6e), $X^9$ can be selected from F, I, L, M, V, W, and Y.

In IL-2Rβ ligands of Formula (6)-(6e), $X^9$ can be L.

In IL-2Rβ ligands of Formula (6)-(6e), $X^{10}$ can be G.

In IL-2Rβ ligands of Formula (6)-(6e), $X^{11}$ can be selected from D, E, H, N, Q, S, T, and Y.

In IL-2Rβ ligands of Formula (6)-(6e), $X^{11}$ can be E.

In IL-2Rβ ligands of Formula (6)-(6e), $X^{12}$ can be L.

In IL-2Rβ ligands of Formula (6)-(6e), $X^{13}$ can be D.

In IL-2Rβ ligands of Formula (6)-(6e), $X^{14}$ can be selected from F, I, L, M, V, W, and Y.

In IL-2Rβ ligands of Formula (6)-(6e), $X^{14}$ can be L.

In IL-2Rβ ligands of Formula (6)-(6e), $X^{15}$ can be selected from D and E.

In IL-2Rβ ligands of Formula (6)-(6e), the IL-2Rβ ligand can be defined by any combination of $X^1$-$X^{15}$ as defined in the immediately preceding twenty seven (27) paragraphs.

In IL-2Rβ ligands of Formula (6)-(6e),
$X^1$ can be selected from H, K, and R;
$X^2$ can be W;
$X^3$ can be Y;
$X^4$ can be P;
$X^5$ can be W;
$X^6$ can be M;
$X^7$ can be A;
$X^8$ can be selected N and Q;
$X^9$ can be selected from L and V;
$X^{10}$ can be G;
$X^{11}$ can be selected from E, D, and Q;
$X^{12}$ can be L;
$X^{13}$ can be D;
$X^{14}$ can be selected from L and M; and
$X^{15}$ can be selected from D and E.

In IL-2Rβ ligands of Formula (6)-(6e),
$X^1$ can be selected from A, D, E, G, H, L, M, N, Q, R, S, T, and V;
$X^2$ can be selected from C, F, W, and Y;
$X^3$ can be selected from F, H, K, L, N, Q, R, S, W, and Y;
$X^4$ can be P;
$X^5$ can be selected from W and Y;
$X^6$ can be selected from F, I, K, L, M, R, S, T, and V;
$X^7$ can be A;
$X^8$ can be selected from D, E, G, H, K, L, N, Q, R, S, and Y;
$X^9$ can be selected from L, P, and V;
$X^{10}$ can be selected from G, H, and W;
$X^{11}$ can be selected from D, E, and Q;

$X^{12}$ can be selected from L and M;
$X^{13}$ can be D;
$X^{14}$ can be selected from L, M, Q, and V; and
$X^{15}$ can be selected from A, D, E, F, G, H, L, N, Q, T, and V.

In IL-2Rβ ligands of Formula (6)-(6e),
$X^{1}$ can be selected from H and R;
$X^{2}$ can be selected from F and W;
$X^{3}$ can be selected from F, L, W, and Y;
$X^{4}$ can be P;
$X^{5}$ can be selected from W and Y;
$X^{6}$ can be selected from F, I, L, M, and V;
$X^{7}$ can be A;
$X^{8}$ can be selected D, E, H, K, N, Q, and R;
$X^{9}$ can be selected from L and V;
$X^{10}$ can be G;
$X^{11}$ can be selected from D, E, and Q;
$X^{12}$ can be selected from L and M;
$X^{13}$ can be D;
$X^{14}$ can be selected L, M, and V; and
$X^{15}$ can be selected from D and E.

In IL-2Rβ ligands of Formula (6)-(6e),
$X^{1}$ can be selected from H and R;
$X^{2}$ can be W;
$X^{3}$ can be Y;
$X^{4}$ can be P;
$X^{5}$ can be W;
$X^{6}$ can be M;
$X^{7}$ can be A;
$X^{8}$ can be Q;
$X^{9}$ can be L;
$X^{10}$ can be G;
$X^{11}$ can be Q;
$X^{12}$ can be L;
$X^{13}$ can be D;
$X^{14}$ can be L; and
$X^{15}$ can be selected from D and E.

In IL-2Rβ ligands of Formula (6)-(6e),
$X^{1}$ can be selected from H and R;
$X^{2}$ can be W;
$X^{3}$ can be L;
$X^{4}$ can be P;
$X^{5}$ can be W;
$X^{6}$ can be M;
$X^{7}$ can be A;
$X^{8}$ can be Q;
$X^{9}$ can be L;
$X^{10}$ can be G;
$X^{11}$ can be Q;
$X^{12}$ can be L;
$X^{13}$ can be D;
$X^{14}$ can be L; and
$X^{15}$ can be selected from D and E.

In IL-2Rβ ligands of Formula (6)-(6e),
$X^{1}$ can be selected from H and R;
$X^{2}$ can be W;
$X^{3}$ can be Y;
$X^{4}$ can be P;
$X^{5}$ can be W;
$X^{6}$ can be M;
$X^{7}$ can be A;
$X^{8}$ can be selected from K and R;
$X^{9}$ can be L;
$X^{10}$ can be G;
$X^{11}$ can be Q;
$X^{12}$ can be L;
$X^{14}$ can be D;

$X^{15}$ can be L; and
$X^{16}$ can be selected from D and E.

An IL-2Rβ ligand can comprise an amino acid sequence selected from any one of SEQ ID NOS: 464-557:

```
SEQ ID NO: 464
A G D W L P C W M A E L G E L C D L E G P T

SEQ ID NO: 465
A Q V R R E W Y P C W M A Q L G E L C D L T

SEQ ID NO: 466
A K G W D T W K P C W L A N L G E L C D L E

SEQ ID NO: 467
D I G Y Y P C W M A Q V G D L C D L D D E K

SEQ ID NO: 468
D S D W W P C W M A Q L G E L C D L E D A R

SEQ ID NO: 469
D V L G D R W Y P C W I A K L G E L C D L D

SEQ ID NO: 470
E G V F F P C W I A R L G E L C D L D H G L

SEQ ID NO: 471
E T E Q M S W Y P C W V A Q L W E L C D L D

SEQ ID NO: 472
E R R P D T W F P C W R A L V G E L C D L E

SEQ ID NO: 473
F Y P C W M A H L G E L C D L D G D T D S M

SEQ ID NO: 474
F Y P C W M A N L G E L C D L D F L R E L N

SEQ ID NO: 475
F Y P C W T A L L G E L C D L E P G P P A M

SEQ ID NO: 476
G E R W K P C W I A Q L G E L C D L D F N W

SEQ ID NO: 477
G R Q Q K G W Y P C W L A Q L G E L C D M E

SEQ ID NO: 478
G E A W Y P C W L A R L G E L C D M D P R V

SEQ ID NO: 479
G T T W Y P C W L A Q L G E L C D L D V L E

SEQ ID NO: 480
G P R F Y P C W I A Q L G E L C D L E D M G

SEQ ID NO: 481
H A S W L P C W L A Q L G E L C D L E P N P

SEQ ID NO: 482
I R S C S P C W S A D V G E L C D L E C E W

SEQ ID NO: 483
I G S W W P C W M A Q L G E L C D L E P E L

SEQ ID NO: 484
K S N F F P C W I A Q L G Q L C D L E P E T

SEQ ID NO: 485
K M H K A V W L P C W M A Q V G E L C D L E

SEQ ID NO: 486
K L Q S W R W Y P C W M A Q L G E L C D L D

SEQ ID NO: 487
K S G W Y P C W M A K L G E L C D L E A Q P

SEQ ID NO: 488
N R R W Y P C W M A Q L G E L C D L D S R P

NGAWYPCWMAQVGELCDLEERW SEQ ID NO: 489

NNSREGWFPCWLAKLGDLCDLD SEQ ID NO: 490

NEPEGGFYPCWLAQLGELCDLH SEQ ID NO: 491

QPCWLAQVGDLCDLLWPGPL SEQ ID NO: 492

QDEAVEWFPCWMARLGELCDLE SEQ ID NO: 493

QTKLEGWYPCWMAQLGELCDLD SEQ ID NO: 494

QDRRSPWYPCWMAKLGELCDLA SEQ ID NO: 495

QDGWLPCWMAQLGELCDLEYKR SEQ ID NO: 496

QGPVRLWYPCWMAQLGELCDLD SEQ ID NO: 497

RKHFYPCWMAQLGELCDLEGMP SEQ ID NO: 498

RQAWYPCWMAQLGELCDLEAEL SEQ ID NO: 499

RQRWYPCWMARLGELCDLDEPT SEQ ID NO: 500

RDESAGYYPCWIAQLGELCDLE SEQ ID NO: 501

RGMCYPCWFARLGELCDLECDQ SEQ ID NO: 502

RVTWYPCWMAQLGELCDLEESV SEQ ID NO: 503

RDQYYPCWMAQLGELCDLDEVF SEQ ID NO: 504

SVVVNNWLPCWMAQLGELCDLD SEQ ID NO: 505

SGHWYPCWMARLGELCDMEERA SEQ ID NO: 506

SEQWWPCWIARLGELCDLDRELSE SEQ ID NO: 507

SWHAETWYPCWLAQVGELCDLD SEQ ID NO: 508

SGHCYPCWLAGLGELCDLNCG SEQ ID NO: 509

TGRWKPCWMAGLHELCDLEGFR SEQ ID NO: 510

TRRWYPCYLAKLGELCDLFEGGTR SEQ ID NO: 511

VMSPTRWLPCWIAKLGELCDLE SEQ ID NO: 512

VPRANAWHPCWMAQLGELCDLE SEQ ID NO: 513

VRPMGVWYPCWIAQLGELCDLV SEQ ID NO: 514

VPRWYPCWIAQLGELCDLDSDD SEQ ID NO: 515

WLPCWIARLGDLCDLE SEQ ID NO: 516

WYPCWMALLGELCDQE SEQ ID NO: 517

WYPCYRARLGELCDLD SEQ ID NO: 518

WQREWRWFPCWMAKLGDMCDLD SEQ ID NO: 519

WYPCWLAQLGDLCDLD SEQ ID NO: 520

WFPCWMAQLGQLCDLE SEQ ID NO: 521

WRPCWRAYLGELCDLEAMPRAT SEQ ID NO: 522

WYPCWMAQLGELCDLQTMGYSH SEQ ID NO: 523

WLPCWIASLGELCDLDTGKRQG SEQ ID NO: 524

WLPCWMAHLGQLCDLDLPGKSM SEQ ID NO: 525

WWPCWMAQLGEMCDLEYPYVPG SEQ ID NO: 526

WGRKEQWLPCWKAQLGELCDLE SEQ ID NO: 527

WLNRHLFNPCWMARLGELCDLE SEQ ID NO: 528

WLPCWLAKLGELCDLEWLPCW SEQ ID NO: 529

WGRNRSWYPCWMAQLGELCDLE SEQ ID NO: 530

WYPCWVAQLGEICDLEMTGPDSWYP SEQ ID NO: 531

WRRWYPCWVAQVGELCDLETEA SEQ ID NO: 532

WYPCWLAQLGELCDLD SEQ ID NO: 533

WYPCWMAQLGELCDLD SEQ ID NO: 395

WYPCWMARLGELCDLE SEQ ID NO: 535

WGTTWRWYPCWMAQLGELCDLE SEQ ID NO: 536

WYPCWIAKLGELCDLE SEQ ID NO: 537

WYPCWIAQLGELCDLD SEQ ID NO: 538

WYPCWLAKLGELCDLD SEQ ID NO: 539

WYPCWMAQPGELCDVD SEQ ID NO: 540

WHPCWIAQLGELCDLE SEQ ID NO: 541

WYPCWIAQLGELCDLE SEQ ID NO: 542

-continued

SEQ ID NO: 543
W Y P C W M A Q L G E L C D L D E S T R L T

SEQ ID NO: 544
W W P C W M A Q L G D L C D L E E T S G G T

SEQ ID NO: 545
W Y P C W M A Q L G E L C D L G P T E S N L

SEQ ID NO: 546
W Y P C W M A N L G E L C D L E Y P S W A Q

SEQ ID NO: 547
W Y P C W M A Q L G E L C D L D A G A R H L

SEQ ID NO: 548
W L P C W M A Q L G D L C D L E Q Y V P L P

SEQ ID NO: 549
W Y P C W M A Q L G E L C D L D D H W P A M

SEQ ID NO: 550
W Y P C W R A Q L G E L C D L D P P I A V E

SEQ ID NO: 551
W Y P C W M A N L G E L C D L E A E R S P V

SEQ ID NO: 552
W Y P C W M A Q L G D L C D L E K P V T E R

SEQ ID NO: 553
W Y P C W I A R L G E L C D L E T S G G F P

SEQ ID NO: 554
Y Y P C W M A R L G E L C D L D

SEQ ID NO: 555
Y Y P C W M A Q L G E L C D L E

SEQ ID NO: 556
Y R G W L P C W R A K L G D L C D L G Q P M

SEQ ID NO: 557
Y L P C W M A H L G E L C D L D S P L K A R

An IL-2Rβ ligand provided by the present disclosure can comprise a truncated amino acid sequence of any one of SEQ ID NOS: 458-557.

An IL-2Rβ ligand provided by the present disclosure can comprise an amino acid sequence selected from any one of SEQ ID NOS: 478-557, or a truncated amino acid sequence of any one of SEQ ID NOS: 458-557, wherein the amino acid sequence can independently comprise from 1 to 4 glycines (G) (SEQ ID NO: 9615) on the N-terminus, on the C-terminus, or on both the N- and C-termini.

An IL-2Rβ ligand provided by the present disclosure can comprise an amino acid sequence selected from any one of SEQ ID NOS: 458-557, or a truncated amino acid sequence of any one of SEQ ID NOS: 458-557, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 458-557 or a truncated amino acid sequence of any one of SEQ ID NOS: 458-557.

An IL-2Rβ ligand of any one of SEQ ID NOS: 458-557 can bind to the hIL-2Rβ subunit with an $IC_{50}$ of less than 10 μM as determined using phage ELISA competition assays.

An IL-2Rβ ligand of any one of SEQ ID NOS: 458-557, a truncated IL-2Rβ ligand of any one of SEQ ID NOS: 458-557, or a substituted IL-2Rβ ligand of any one of SEQ ID NOS: 458-557 can bind to the hIL-2Rβ subunit with an $IC_{50}$ of less than 100 μM or less than 10 μM as determined using phage ELISA competition assays.

An IL-2Rβ ligand of any one of SEQ ID NOS: 464-557 bind to the hIL-2Rβ subunit with an $IC_{50}$ of less than 100 μM.

An IL-2Rβ ligand can have the amino acid sequence of any one of SEQ ID NOS: 558-572:

SEQ ID NO: 558
G G Y D C R I A Q V G E L C D L G G

SEQ ID NO: 559
G G V Q Y K K C W M A Q L G D L C E L D P S G G

SEQ ID NO: 560
G G W G T T W R W Y P C W M A Q L G E L C D L E G G

SEQ ID NO: 561
G G Y P C H M A Q L G E L C D L W S W G D I G G

SEQ ID NO: 562
G G F Y P C W T A L L G E L C D L E P G P P A M G G

SEQ ID NO: 563
G G W R R W Y P C W V A Q V G E L C D L E I E A G G

SEQ ID NO: 564
G G R Q R W Y P C W M A R L G E L C D L D E P T G G

SEQ ID NO: 565
G G W Y P C W M A Q L G D L C D L E K P V T E R G G

SEQ ID NO: 566
G G D V L G D R W Y P C W I A K L G E L C D L D G G

SEQ ID NO: 567
G G W Y P C W I A Q L G E L C D L D G G

SEQ ID NO: 568
G G W Y P C W L A K L G E L C D L D G G

SEQ ID NO: 569
F Y P C W T A L L G E L C D L E P G P P A M G G

SEQ ID NO: 570
W R R W Y P C W V A Q V G E L C D L E I E A G G

SEQ ID NO: 571
R Q R W Y P C W M A R L G E L C D L D E P T G G

SEQ ID NO: 572
W Y P C W M A Q L G D L C D L E K P V T E R G G

An IL-2Rβ ligand provided by the present disclosure can comprise an amino acid sequence of Formula (7) (SEQ ID NO: 575), an amino acid sequence of Formula (7a) (SEQ ID NO: 576), an amino acid sequence of Formula (7b) (SEQ ID NO: 577), an amino acid sequence of Formula (7c) (SEQ ID NO: 578), an amino acid sequence of Formula (7d) (SEQ ID NO: 579):

$$-X^1-X^2-X^3-C-X^4-X^5-X^6-X^7-X^8-X^9-X^{10}-X^{11}-C-X^{12}-X^{13}-X^{14}- \quad (7a)$$

$$-X^2-X^3-C-X^4-X^5-X^6-X^7-X^8-X^9-X^{10}-X^{11}-C-X^{12}-X^{13}- \quad (7a)$$

$$-X^3-C-X^4-X^5-X^6-X^7-X^8-X^9-X^{10}-X^{11}-C-X^{12}- \quad (7b)$$

-C-$X^4$-$X^5$-$X^6$-$X^7$-$X^8$-$X^9$-$X^{10}$-$X^{11}$-C- (7c)

-$X^4$-$X^5$-$X^6$-$X^7$-$X^8$-$X^9$-$X^{10}$-$X^{11}$- (7d)

wherein, $X^1$ can be selected from E, F, G, I, L, R, S, W, and Y;
$X^2$ can be selected from F, H, K, L, N, Q, S, T, V, W, and Y;
$X^3$ can be selected from E, G, L, P, and S;
$X^4$ can be selected from E, F, G, H, Q, R, S, W, and Y;
$X^5$ can be selected from E, I, K, L, M, N, R, S, T, and V;
$X^6$ can be selected from A, D, G, and Y;
$X^7$ can be selected from A, C, D, E, G, H, K, L, N, Q, R, S, and T;
$X^8$ can be selected from D, F, L, M, P, R, and V;
$X^9$ can be selected from G, R W, and Y;
$X^{10}$ can be selected from A, D, E, Q, W, and Y;
$X^{11}$ can be selected from I, L, Q, V, and Y;
$X^{12}$ can be selected from D, E, G, H, V, and Y;

$X^1$ can be selected from D, F, H, I, K, L, M, and V; and $X^{14}$ can be selected from A, D, E, G, H, K, L, N, Q, V, and W.

In an IL-2Rβ ligand of Formula (7)-(7d), $X^1$ can be selected from S, W, and Y.

In an IL-2Rβ ligand of Formula (7)-(7d), $X^1$ can be W.

In an IL-2Rβ ligand of Formula (7)-(7d), $X^2$ can be selected from K, L, W, and Y.

In an IL-2Rβ ligand of Formula (7)-(7d), $X^3$ can be P.

In an IL-2Rβ ligand of Formula (7)-(7d), $X^4$ can be W.

In an IL-2Rβ ligand of Formula (7)-(7d), $X^5$ can be selected from I, L, and M

In an IL-2Rβ ligand of Formula (7)-(7d), $X^6$ can be A.

In an IL-2Rβ ligand of Formula (7)-(7d), $X^7$ can be Q.

In an IL-2Rβ ligand of Formula (7)-(7d), $X^8$ can be L.

In an IL-2Rβ ligand of Formula (7)-(7d), $X^9$ can be G.

In an IL-2Rβ ligand of Formula (7)-(7d), $X^{10}$ can be selected from D and E.

In an IL-2Rβ ligand of Formula (7)-(7d), $X^{11}$ can be L.

In an IL-2Rβ ligand of Formula (7)-(7d), $X^{12}$ can be selected from D and E.

In an IL-2Rβ ligand of Formula (7)-(7d), $X^{13}$ can be L.

In an IL-2Rβ ligand of Formula (7)-(7d), $X^{14}$ can be selected from D and E.

In an IL-2Rβ ligand of Formula (7)-(7d), the IL-2Rβ ligand can be defined by any combination of $X^1$ to $X^{14}$ as defined in the immediately preceding seventeed (17) paragraphs.

In an IL-2Rβ ligand of Formula (7)-(7d), $X^1$ can be selected from S, W, and Y;

$X^2$ can be selected from K, L, W, and Y;

$X^3$ can be P;

$X^4$ can be W;

$X^5$ can be selected from I, L, and M;

$X^6$ can be A;

$X^7$ can be Q;

$X^8$ can be L;

$X^9$ can be G;

$X^{10}$ can be selected from D and E;

$X^{11}$ can be L;

$X^{12}$ can be selected from D and E;

$X^{13}$ can be L; and $X^{14}$ can be selected from D and E.

In an IL-2Rβ ligand of Formula (7)-(7d), $X^1$ can be W;

$X^2$ can be selected from K, L, W, and Y;

$X^3$ can be P;

$X^4$ can be W;

$X^5$ can be selected from I, L, and M;

$X^6$ can be A;

$X^7$ can be Q;

$X^8$ can be L;

$X^9$ can be G;

$X^{10}$ can be selected from D and E;

$X^{11}$ can be L;

$X^{12}$ can be selected from D and E;

$X^{13}$ can be L; and $X^{14}$ can be selected from D and E.

An IL-2R ligand can comprise the amino acid sequence of any one of SEQ ID NOS: 580-655:

SEQ ID NO: 580
V R A W Y P C W I A R L G E L C D L E V D

SEQ ID NO: 581
W F P C W M A Q L G E V C D L D

SEQ ID NO: 582
W Y P C H M A K L R E L C D L D

SEQ ID NO: 583
S L P C W M A Q L G D L C E L H

SEQ ID NO: 584
S N P C W M A Q L W E L C D L E

SEQ ID NO: 585
Y K P C W I A Q L G E L C E L E

SEQ ID NO: 586
W Q P C W M A Q L G E L C D L E

SEQ ID NO: 587
W K P C W L A Q L G D L C E M E

SEQ ID NO: 588
W L P C W M A K L G D L C E L E

SEQ ID NO: 589
W L P C W M A Q L G E L C V M E

SEQ ID NO: 590
L H P C W M A Q L G E L C D L E

SEQ ID NO: 591
S L P C W M A Q L G E L C D L V

SEQ ID NO: 592
W K P C W M A G L G E L C E L D

SEQ ID NO: 593
W W P C S S A E L G E I C D F D

SEQ ID NO: 594
W Q P C W R A K L G E L C D L E

SEQ ID NO: 595
W S P C W I A T L G E L C D L D

SEQ ID NO: 596
W N P C W I A Q L G D L C D M V

SEQ ID NO: 597
W L P C W L A H L G D I C D L Q

SEQ ID NO: 598
W L S P P S Y L P C W M A Q L G E L C D L V

SEQ ID NO: 599
W D V H A I R N P C W L A K L G D L C D L D

SEQ ID NO: 600
G A G V L H R W P C W M A K L G D L C D L D

SEQ ID NO: 601
D T G R D G W K P C W M A L L G E L C E L E

EQGMLGYFPCWKALLGDVCDLD
SEQ ID NO: 602

WRVTASLQPCWMAQLGELCDLN
SEQ ID NO: 603

GQVVETSLPCWEAQLGELCVLD
SEQ ID NO: 604

TVGQFEWYPCSTAQLGELCDLD
SEQ ID NO: 605

ALVGGTFYPCYVAHLGELCDIE
SEQ ID NO: 606

IDRADGWKPCWIAQVGELCVLE
SEQ ID NO: 607

YRRERVEFPCWLAQLGELCDKE
SEQ ID NO: 608

AVSHGNWLPCYIAQLGELCDLD
SEQ ID NO: 609

IPKGESWFPCWMAAMGELCDLE
SEQ ID NO: 610

WYPCWIAQLGEVCDLEKQTGSV
SEQ ID NO: 611

WYPCWMAHLGDVCDLESFGQTE
SEQ ID NO: 612

YKPCQMAQLGELCDLDVDNKAE
SEQ ID NO: 613

FKPCWIANLGELCDMDDERSSE
SEQ ID NO: 614

WKPCWMARLGELCDIEDTKVNA
SEQ ID NO: 615

SLPCWIARLGELCDLDGYDGEE
SEQ ID NO: 616

FYPCWKARLGELCELEELRGYY
SEQ ID NO: 617

WKPCWIADLGELCDLAPAWHEY
SEQ ID NO: 618

RLPCWRAQLGDLCELDWGLDMG
SEQ ID NO: 619

SKPCWMAQLGELCDLDVWNLQM
SEQ ID NO: 620

GYPCWLAQLGDYCDLDAGAPSW
SEQ ID NO: 621

SWPCWMAQLGDLCDLDGSAGAS
SEQ ID NO: 622

WKPCWLAQLGELCDLERPSTTS
SEQ ID NO: 623

WYSCGKAQLGELCDLDVESQPG
SEQ ID NO: 624

YVPCYMARLGELCELEANRPGQ
SEQ ID NO: 625

SKPCWLAQLGDLCDFDWTAADH
SEQ ID NO: 626

WFPCWMAQLGDLCELEPDSVPA
SEQ ID NO: 627

WTPCWIAHLGDLCDLEPQDDTD
SEQ ID NO: 628

WKPCFIASLGELCDLDQGSVEV
SEQ ID NO: 629

WKPCWMAALGELCDLERSVGKV
SEQ ID NO: 630

WKPCWRAQLGELCDLELGPSER
SEQ ID NO: 631

FFPCWMGQLGDLCDLEVRSMQK
SEQ ID NO: 632

YWPCSMASLGELCDLEWQGRLP
SEQ ID NO: 633

WYPCYMASLGELCDLQSSISPR
SEQ ID NO: 634

WYPCWMAQLGELCDHEWPSYGA
SEQ ID NO: 635

MGSWLPCWMAQLGDLCDVEGGM
SEQ ID NO: 636

QKGFLPCWRAQLGQLCDMESQY
SEQ ID NO: 637

GSGWQPCWMADLGELCDLDNEK
SEQ ID NO: 638

WRRWYPCWMAQLGELCDLDQWT
SEQ ID NO: 639

RRSWYPCRIAQLGELCDLDPRV
SEQ ID NO: 640

AYRIYPCWKAQLGELCDLDNAD
SEQ ID NO: 641

QRNSFPCWLAQLGDLCDLGDWA
SEQ ID NO: 642

QPAWLPCWLAQLGELCDLGTGA
SEQ ID NO: 643

SRFWQPCWMAQLGELCHLDPQM
SEQ ID NO: 644

YLNFNPCWTAQLGELCDLASGE
SEQ ID NO: 645

STGWYPCWIAEFGELCDLVKPH
SEQ ID NO: 646

AHWSQPCWTAQLGELCDLDMGD
SEQ ID NO: 647

HPVRYPCWVAQLGELCDLENGN
SEQ ID NO: 648

QTGSYPCWIAHLGELCDLEGSA
SEQ ID NO: 649

TGWWYPCWMAQLGELCDLQQT
SEQ ID NO: 650

DLWQPCWMARLGELCDLKG
SEQ ID NO: 651

MGTGWQNYCRYAQLGELCLL
SEQ ID NO: 652

WYPCGVAQPGDLCDLE
SEQ ID NO: 653

MLGEWLCEMDQLGYLCYLDHGD
SEQ ID NO: 654

WDGWECGMDHDGWVCEFWGE
SEQ ID NO: 655

An IL-2Rβ ligand provided by the present disclosure can comprise a truncated amino acid sequence of any one of SEQ ID NOS: 575-655.

An IL-2Rβ ligand provided by the present disclosure can comprise an amino acid sequence selected from any one of SEQ ID NOS: 575-655, or a truncated amino acid sequence of any one of SEQ ID NOS: 575-655, wherein the amino acid sequence can independently comprise from 1 to 4 glycines (SEQ ID NO: 9615) on the N-terminus, on the C-terminus, or on both the N- and C-termini.

An IL-2Rβ ligand provided by the present disclosure can comprise an amino acid sequence selected from any one of SEQ ID NOS: 575-655, or a truncated amino acid sequence of any one of SEQ ID NOS: 575-655, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 575-655 or to a truncated amino acid sequence of any one of SEQ ID NOS: 575-655.

An IL-2Rβ ligand of anyone of SEQ ID NOS: 575-655, a truncated IL-7Rα ligand of anyone of SEQ ID NOS: 575-655, or a substituted IL-7Rα ligand of any one of SEQ ID NOS: 575-655 can bind to the hIL-2Rβ subunit with an $IC_{50}$ of less than 100 μM or less than 10 μM as determined using phage ELISA competition assays.

An IL-2Rβ ligand of any one of SEQ ID NOS: 575-655 bound to the hIL-2Rβ subunit with an $IC_{50}$ of less than 100 μM as determined using phage ELISA competition assays.

An IL-2Rβ ligand provided by the present disclosure can comprise the amino acid sequence of Formula (8) (SEQ ID NO: 661), an amino acid sequence of Formula (8a) (SEQ ID NO: 662), an amino acid sequence of Formula (8b) (SEQ ID NO: 663), an amino acid sequence of Formula (8c) (SEQ ID NO: 664), an amino acid sequence of Formula (8d) (SEQ ID NO: 665), an amino acid sequence of Formula (8e) (SEQ ID NO: 666):

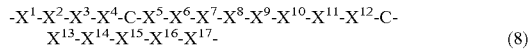  (8)

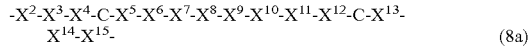  (8a)

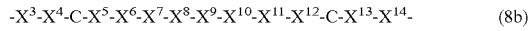  (8b)

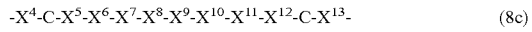  (8c)

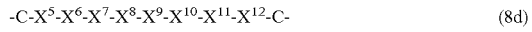  (8d)

  (8e)

wherein, $X^1$ can be selected from A, D, E, F, G, H, I, K, L, M, N, P, Q, R, S, T, V, W, and Y;

$X^2$ can be selected from C, D, F, G, I, L, M, R, S, V, W, and Y;

$X^3$ can be selected from A, D, F, H, K, L, N, P, Q, R, S, T, V, W, and Y;

$X^4$ can be selected from A, D, F, L, N, P, Q, S, T, and W;

$X^5$ can be selected from D, E, F, G, L, M, Q, R, S, W, and Y;

$X^6$ can be selected from A, F, I, K, L, M, N, Q, R, S, V, W, and Y;

$X^7$ can be selected from A, D, E, I, S, T, V, and W;

$X^8$ can be selected from A, E, F, G, H, K, L, N, P, Q, R, S, V, W, and Y;

$X^9$ can be selected from A, E, I, L, M, P, Q V, and W;

$X^{10}$ can be selected from F, G, and V;

$X^{11}$ can be selected from D, E, N, P, Q, S, V, W, and Y;

$X^{12}$ can be selected from D, F, H, I, L, M, Q, S, T, V, W, and X;

$X^{13}$ can be selected from A, D, E, L, N, Q, S, T, and V;

$X^{14}$ can be selected from A, E, F, I, K, L, M, Q, R S, T V, and W;

$X^{15}$ can be selected from A, D, E, F, G, I, K, L, N, P, Q, R, T, V, W, and Y;

$X^{16}$ can be selected from A, C, D, E, F, G, H, I, L, M, N, P, Q, R, S, T, V, W, and Y; and $X^{17}$ can be selected from A, D, E, F, G, H, I, K, L, M N, P, Q, R, S, T, V, W, and Y.

In an IL-2Rβ ligand of Formula (8)-(8e), X can be selected from A, D, E, G, R, S, T, V, and W.

In an IL-2Rβ ligand of Formula (8)-(8e), X can be selected from G, R, and W.

In an IL-2Rβ ligand of Formula (8)-(8e), $X^2$ can be selected from F, L, S, V, W, and Y.

In an IL-2Rβ ligand of Formula (8)-(8e), $X^2$ can be selected from F and W.

In an IL-2Rβ ligand of Formula (8)-(8e), $X^3$ can be selected from F, H, K, L, N, Q, W, and Y.

In an IL-2Rβ ligand of Formula (8)-(8e), $X^3$ can be selected from F, H, L, W, and Y.

In an IL-2Rβ ligand of Formula (8)-(8e), $X^4$ can be selected from D and P.

In an IL-2Rβ ligand of Formula (8)-(8e), $X^5$ can be selected from F, L, S, W, and Y.

In an IL-2Rβ ligand of Formula (8)-(8e), $X^5$ can be selected from F, W, and Y.

In an IL-2Rβ ligand of Formula (8)-(8e), $X^6$ can be selected from F, I, K, L, M, R, and V.

In an IL-2Rβ ligand of Formula (8)-(8e), $X^6$ can be selected from I, L, and M.

In an IL-2Rβ ligand of Formula (8)-(8e), $X^7$ can be A.

In an IL-2Rβ ligand of Formula (8)-(8e), $X^8$ can be selected from H, K, L, Q, R, and S.

In an IL-2Rβ ligand of Formula (8)-(8e), $X^8$ can be Q.

In an IL-2Rβ ligand of Formula (8)-(8e), $X^9$ can be selected from I, L, and V.

In an IL-2Rβ ligand of Formula (8)-(8e), $X^9$ can be selected from L and V.

In an IL-2Rβ ligand of Formula (8)-(8e), $X^{10}$ can be G.

In an IL-2Rβ ligand of Formula (8)-(8e), $X^{11}$ can be selected from D and E.

In an IL-2Rβ ligand of Formula (8)-(8e), $X^{11}$ can be E.

In an IL-2Rβ ligand of Formula (8)-(8e), $X^{12}$ can be selected from L and V.

In an IL-2Rβ ligand of Formula (8)-(8e), $X^{12}$ can be L.

In an IL-2Rβ ligand of Formula (8)-(8e), $X^{13}$ can be selected from D and E.

In an IL-2Rβ ligand of Formula (8)-(8e), $X^{13}$ can be D.

In an IL-2Rβ ligand of Formula (8)-(8e), $X^{14}$ can be selected from F, I, L, and M.

In an IL-2Rβ ligand of Formula (8)-(8e), $X^{14}$ can be L.

In an IL-2Rβ ligand of Formula (8)-(8e), $X^{15}$ can be selected from D, E, F, G, and V.

In an IL-2Rβ ligand of Formula (8)-(8e), $X^{15}$ can be selected from D, E, F, and G.

In an IL-2Rβ ligand of Formula (8)-(8e), $X^{16}$ can be selected from D, E, G, K, P, V, and W.

In an IL-2Rβ ligand of Formula (8)-(8e), $X^{16}$ can be G.

In an IL-2Rβ ligand of Formula (8)-(8e), $X^{17}$ can be selected from A, E, G, P, Q, S, T, V, and W.

In an IL-2Rβ ligand of Formula (8)-(8e), $X^{17}$ can be G.

In an IL-2Rβ ligand of Formula (8)-(8e), the IL-2Rβ ligand can be defined by any combination of $X^1$ to $X^{17}$ as defined in the immediately preceding thirty one (31) paragraphs.

In an IL-2Rβ ligand of Formula (8)-(8e), $X^1$ can be selected from A, D, E, G, R, S, T, V, and W;
$X^2$ can be selected from F, L, S, V, W, and Y;
$X^3$ can be selected from F, H, K, L, N, Q, W, and Y;
$X^4$ can be selected from D and P;
$X^5$ can be selected from F, L, S, W, and Y;
$X^6$ can be selected from F, I, K, L, M, R, and V;
$X^7$ can be A;
$X^8$ can be selected from H, K, L, Q, R, and S;
$X^9$ can be selected from I, L, and V;
$X^{10}$ can be G;
$X^{11}$ can be selected from D and E;
$X^{12}$ can be selected from L and V;
$X^{13}$ can be selected from D and E;
$X^{14}$ can be selected from F, I, L, and M;
$X^{15}$ can be selected from D, E, F, G, and V;
$X^{16}$ can be selected from D, E, G, K, P, V, and W;
$X^{17}$ can be selected from A, E, G, P, Q, S, T, V, and W.

In an IL-2Rβ ligand of Formula (8)-(8e), $X^1$ can be selected from G, R, and W;
$X^2$ can be selected from F and W;
$X^3$ can be selected from F, H, L, W, and Y;
$X^4$ can be selected from D and P;
$X^5$ can be selected from F, W, and Y;
$X^6$ can be selected from I, L, and M;
$X^7$ can be A;
$X^8$ can be Q;
$X^9$ can be selected from L and V;
$X^{10}$ can be G;
$X^{11}$ can be E;
$X^{12}$ can be L;
$X^{13}$ can be D;
$X^{14}$ can be L;
$X^{15}$ can be selected from D, E, F, and G;
$X^{16}$ can be G; and
$X^{17}$ can be G.

An IL-2Rβ ligand can comprise the amino acid sequence of anyone of SEQ ID NO: 667-891.

SEQ ID NO: 667
W Y P C W I A Q L G E L C D L D A K G Q R R

SEQ ID NO: 668
T N N F Y P C W L A K L G D L C D F D D L N

SEQ ID NO: 669
W Y P C W I A R V G E L C D L E E G P V N R

SEQ ID NO: 670
A V E F Y P C W L A R I G E L C D L V E P

SEQ ID NO: 671
W Y P C W I A H L G E L C D L E

SEQ ID NO: 672
W Y P C W I A R V G E L C D M E

SEQ ID NO: 673
R R E W Y P C W I A Q V G E L C D L P L I

-continued

SEQ ID NO: 674
R W P W Y P C E I A R I G E L C D L E Q A N

SEQ ID NO: 675
F G A F Y P C W K A Q L G E L C D L E P V T

SEQ ID NO: 676
H G R W F P C W M A Q V G D L C D L E H S N

SEQ ID NO: 677
W Y P C W L A K L G E L C D L D R A E A L P

SEQ ID NO: 678
V W F P C W F A Q L G D L C D L D Q D P

SEQ ID NO: 679
E T L G S V W Y P C W I A S I G E L C D L D

SEQ ID NO: 680
W Y S C W I A Q L G E L C D L D D M G D R V

SEQ ID NO: 681
W F P C W L A Q L G E L C D K E

SEQ ID NO: 682
W Y P C W I A Q L G E L C D L V

SEQ ID NO: 683
S H L W F P C W M A Q L G E L C D L E G G P

SEQ ID NO: 684
R R W L P C W M A H V G E L C D L E L G N

SEQ ID NO: 685
Y W C W F A R V G E L C D L D D G G V P S

SEQ ID NO: 686
W Y S C W I A Q I G E L C D L E

SEQ ID NO: 687
M N P V G T F Y P C W I A K L G E L C D L Q

SEQ ID NO: 688
H G G V I G W Y P C W M A K V G E L C D L D

SEQ ID NO: 689
W Y P C S I A L L G E L C D L E S V H E K S

SEQ ID NO: 690
E Q R N R Q W W P C W L A R L G D L C D L D

SEQ ID NO: 691
W Y P C W L A Q L G E L C D L D

SEQ ID NO: 692
W L P C W M A H L G D L C D L E

SEQ ID NO: 693
R P S W A P C W L A Q V G E L C D L D H P E

SEQ ID NO: 694
E S K E P A F W P C W M A Q L G D L C D L E

SEQ ID NO: 695
R S L R E S W F P C W M A K L G D L C D L E

SEQ ID NO: 696
W H P C W L A R V G D L C D L D

SEQ ID NO: 697
S R S A G E Y Y P C W L A Q L G E L C D L A

SEQ ID NO: 698
R Q V P K Q W Y P C W M A A L G E L C D L E

SEQ ID NO: 699
W Y P C W L A H L G E L C D L E

SEQ ID NO: 700
Q V M R L W Y P C W M A Q L G E L C D L E

```
WYPCWMAQLGELCDLDEAPVQP             SEQ ID NO: 701
RDIWWPCWVAQLGELCDLDDPQ             SEQ ID NO: 702
SATWYPCFLANLGELCDLEQEN             SEQ ID NO: 703
YAEWYPCWMARVGEVCDLEVTP             SEQ ID NO: 704
RSGDKAFFPCWLAQLGDLCDLD             SEQ ID NO: 705
WYPCWMAQLGELCDMD                   SEQ ID NO: 706
RVSYPCWLARLGELCDMDLEE              SEQ ID NO: 707
TESWYPCWLANLGDLCDLEWSA             SEQ ID NO: 708
WLPCWMADVGDLCDLD                   SEQ ID NO: 709
WHPCWMARLGELCDLD                   SEQ ID NO: 710
QGTKWHWNPCWMAQLGELCDLD             SEQ ID NO: 711
KNGPKSWYPCWMAQVGDLCDLD             SEQ ID NO: 712
SGTGPAWYPCFLASLGQLCDLE             SEQ ID NO: 713
WYPCWMARMGELCDLE                   SEQ ID NO: 714
WLPCWRAQLGQLCDLD                   SEQ ID NO: 715
LFPCWLAQLGELCDLE                   SEQ ID NO: 716
RYPCWIAQLGELCDLD                   SEQ ID NO: 717
WHPCWIAHLGELCDLE                   SEQ ID NO: 718
MYPCWIAHLGELCDLD                   SEQ ID NO: 719
WYPCSIASLGELCDLE                   SEQ ID NO: 720
WLPCYMAQLGDLCDLE                   SEQ ID NO: 721
WHPCWMAQVGEVCDLD                   SEQ ID NO: 722
WYPCWLASLGEVCDLE                   SEQ ID NO: 723
WWPCSIARLGQLCDLD                   SEQ ID NO: 724
WYPCWLAHLGELCDLA                   SEQ ID NO: 725
WYPCWLAQLGELCDAE                   SEQ ID NO: 726
WKPCWMALLGELCDLE                   SEQ ID NO: 727
RYPCWRAKLGELCDLD                   SEQ ID NO: 728
EEQSRGFLPCWMALLGELCDLD             SEQ ID NO: 729
LGSKRQWYPCWVAHLGELCDLE             SEQ ID NO: 730
ESEGRGWYPCWNALLGELCDLE             SEQ ID NO: 731
RWTQAQWYPCWLAQLGELCDLE             SEQ ID NO: 732
LHAGRWNPCWLAQLGELCDLE              SEQ ID NO: 733
LSSKGWYPCWKARLGDLCDLE              SEQ ID NO: 734
DMFTHRWYPCSMAKLGELCDLE             SEQ ID NO: 735
MTDRAFWNPCWVARLGELCDLD             SEQ ID NO: 736
NVTYTQWFPCWLARLGELCDLV             SEQ ID NO: 737
VRTRIWYPCWSAQLGELCDLD              SEQ ID NO: 738
AMARRYLPCWIAKLGELCELD              SEQ ID NO: 739
ARGEYRWFPCWMARLGELCDLE             SEQ ID NO: 740
YLERSRWYPCFIAQLGELCDLE             SEQ ID NO: 741
FRVSRDWFPCWMAQLGEVCDLE             SEQ ID NO: 742
IERAWEWRPCWLASVGELCDLE             SEQ ID NO: 743
VASERFYPCWIARLGELCDVE              SEQ ID NO: 744
WYPCWIAKLGEVCDLDQGTTRQ             SEQ ID NO: 745
WYPCWLAHLGELCDLDWKGRND             SEQ ID NO: 746
WYPCWRAQLGELCDLVDLGSHL             SEQ ID NO: 747
WSPCWMASLGDLCDLEETRQTE             SEQ ID NO: 748
WTPCWIAQLGELCDLEGRHGTV             SEQ ID NO: 749
LPCWIAQLGDLCDLEPEPSPE              SEQ ID NO: 750
FYPCWAAHLGDLCDLEYQEAGP             SEQ ID NO: 751
WLPCWLAPLGDLCDMDSAVMN              SEQ ID NO: 752
WRPCWMAHLGDLCDLEMANENP             SEQ ID NO: 753
WYPCWLAQLGEVCDLDDGGGVF             SEQ ID NO: 754
```

WWPCWLAQLGELCDLEVNGSLI  SEQ ID NO: 755

TEMWYPCWMAYQGELCDLDMTY  SEQ ID NO: 756

ARTWWPCWRAKLGELCDLVVPE  SEQ ID NO: 757

HQGFYSCRLARLGELCDLDTGW  SEQ ID NO: 758

VDEFYPCSMAGLGELCDLERQN  SEQ ID NO: 759

AWDWYPCSVAALGEICDLDIQD  SEQ ID NO: 760

RPPWYPCWMARLGEVCDMDIML  SEQ ID NO: 761

SQRWYPCWVAHLGELCDLEGVV  SEQ ID NO: 762

KGSWQPCWFAKLGELCDLHPTS  SEQ ID NO: 763

QTWYLPCWMAKLGELCDLGERD  SEQ ID NO: 764

EPRWYPCWMAQMGELCDMEMSD  SEQ ID NO: 765

WGGRYWCWMAKLGDLCDLEDEW  SEQ ID NO: 766

WWPCWIAQVGELCDLDGPGRPT  SEQ ID NO: 767

RLVYDCLFAQVGDLCEVIS  SEQ ID NO: 768

WRILWMQQCWRSHVVNQCAL  SEQ ID NO: 769

WYPCWIAQVGELCDLDEVSHGR  SEQ ID NO: 770

TGEWWPCWVAEVGELCDLERGP  SEQ ID NO: 771

ARTQGWYDCLFAQVGELCDL  SEQ ID NO: 772

FHPCWRALLGELCDLETALGPS  SEQ ID NO: 773

LQIRKLWACRIDLVGPFCLL  SEQ ID NO: 774

AEYSGRYDCYIAKVGELCDI  SEQ ID NO: 775

SWRFLWQDCGRAHVGELCDL  SEQ ID NO: 776

NRWWHPCWMARVGELCDLEPDA  SEQ ID NO: 777

WWPCWVAKLGELCDLEGDASRV  SEQ ID NO: 778

WYPCEFAQLGELCDLLPFPYPA  SEQ ID NO: 779

SYMHDCFMAQVGDLCDRFIS  SEQ ID NO: 780

WWPCWIAQVGELCDLEEESRES  SEQ ID NO: 781

KWAWNPCYIARLGELCDLVEPE  SEQ ID NO: 782

WWPCWIADLGELCDLEGPPRGR  SEQ ID NO: 783

PTLITWYDCLFAEVGELCDM  SEQ ID NO: 784

EISNWFLDCMFADVGDLCDL  SEQ ID NO: 785

AQVWYPCWLAKVGELCDLDQWN  SEQ ID NO: 786

FGGKMDWYPCWIANLGELCDLK  SEQ ID NO: 787

WFPCWMAKVGDLCDVDEHQDPS  SEQ ID NO: 788

MGDSSSWFPCWMAQLGELCDME  SEQ ID NO: 789

MFRYYPCWIASIGELCDLEWGV  SEQ ID NO: 790

ERRWYPCWLASVGELCDLDMGD  SEQ ID NO: 791

WYPCWVAQLGELCDLE  SEQ ID NO: 792

RWDYWPCYIAQVGELCDLEVYE  SEQ ID NO: 793

SLAHRSWYPCWLAQVGELCDLD  SEQ ID NO: 794

QNASKGWYPCWIAHVGELCDWD  SEQ ID NO: 795

HRWYPCWLAHLGELCDLDPMS  SEQ ID NO: 796

FYPCWIAFVGELCDLE  SEQ ID NO: 797

EGHWYPCWIAQLGELCDLDW  SEQ ID NO: 798

WTGWSAFYPCSIANLGELCDLD  SEQ ID NO: 799

WEKLQNWYPCWIAQMGELCDLE  SEQ ID NO: 800

TNGVLDWWPCWMAQVGELCDLD  SEQ ID NO: 801

WYPCWVAKLGELCDLE  SEQ ID NO: 802

AYYPCELAQLGELCDLYNI  SEQ ID NO: 803

WYPCWMAHLGELCDLE  SEQ ID NO: 804

NDHTAWWPCYFAQVGDLCDLV  SEQ ID NO: 805

WWPCEIAQIGELCDLEWVRHAE  SEQ ID NO: 806

WWPCDFAQIGELCDLGPRFTGE  SEQ ID NO: 807

RDWWLPCEFALIGELCDLERSW  SEQ ID NO: 808

MRTTFWYDCYIAQVGELCDF SEQ ID NO: 809

SWHAETWYPCWLAQVGELCDLD SEQ ID NO: 810

EWFHDCFLAKVGDLCDLFLW SEQ ID NO: 811

SGKTQMWNPCYVAKVGELCDLV SEQ ID NO: 812

DKAGPNFYPCWLAHVGELCDQA SEQ ID NO: 813

AGFRGRWWPCEYAQVGELCDLE SEQ ID NO: 814

WFPCWLAKVGELCDRDDLAGPS SEQ ID NO: 815

WWPCEWARIGELCDLE SEQ ID NO: 816

KGSSWFPCYFAQVGDLCDLY SEQ ID NO: 817

WYPCWLAQVGELCDRE SEQ ID NO: 818

RGVYFPCWLAKVGDLCDSDEF SEQ ID NO: 819

RAWWWPCELAQVGELCDLEPSS SEQ ID NO: 820

WYPCWLAKVGELCDQE SEQ ID NO: 821

RYVPDCLKAQVGDLCDFFAW SEQ ID NO: 822

WWPCYLAQIGELCDLV SEQ ID NO: 823

WYPCWMAKVGELCDME SEQ ID NO: 824

QITDSGWYPCWVAKVGELCDMD SEQ ID NO: 825

YRWWYPCDIAQVGELCDLDYLL SEQ ID NO: 826

CYMHDCFMAQVGDLCDRFIS SEQ ID NO: 827

WLPCWIAKIGDLCDLD SEQ ID NO: 828

SRVWHPCWLARVGELCDLEVSD SEQ ID NO: 829

WEHEFTWYPCWIAQVGELCDMD SEQ ID NO: 830

HRGWVGWYPCEYALPGQLCDLE SEQ ID NO: 831

WYPCWLAQLGELCDQDWDTPS SEQ ID NO: 832

RVRRHSWWPCEIAVVGELCDLE SEQ ID NO: 833

DGWWPCWIAQVGELCDLEDPV SEQ ID NO: 834

LPFQDCYIAQVGELCDLPGT SEQ ID NO: 835

RWMFDCLFARVGELCDIRPW SEQ ID NO: 836

GGYYDCLIAEVGELCDMPGQ SEQ ID NO: 837

VVCYACDIAHVGELCDLTCR SEQ ID NO: 838

TPWYDCYIANVGDLCDFASA SEQ ID NO: 839

LESLDCFFARIGDLCEIWDV SEQ ID NO: 840

WQIFDCYLAQVGELCDLQDT SEQ ID NO: 841

GRYPDCYIAHVGELCEFYDG SEQ ID NO: 842

FGDDFCRFIPLFEMCTTDVE SEQ ID NO: 843

LVYYDCYMAQVGELCDLPSL SEQ ID NO: 844

VSRYDCYIAKVGELCDFFEF SEQ ID NO: 845

VTVQDCYFARVGDLCDLFSP SEQ ID NO: 846

WEWYDCLMAQVGELCDFEGN SEQ ID NO: 847

WAFYDCRNAQVGDFCDLWEF SEQ ID NO: 848

SMDQDCYFAQVGELCVLFNQ SEQ ID NO: 849

GGYYDCLIAEVGELCDIYGR SEQ ID NO: 850

SNWHDCLFAQVGELCDLPGS SEQ ID NO: 851

YDCYIAQVGELCDI SEQ ID NO: 852

SWLSDLQDCYIAQVGDLCQI SEQ ID NO: 853

SEQ ID NO: 854

RLASDWWDCYIAKVGELCDF SEQ ID NO: 855

RLLRDCFLAKVGDLCELFVW SEQ ID NO: 856

QWFHNCFLARVGDTCDLFLW SEQ ID NO: 857

ELLVDCFKVKVGELCDLFFG SEQ ID NO: 858

RYVHDCFIAQVGDLCDLFLH SEQ ID NO: 859

KWVHDCFLAKVGDVCDLFVV SEQ ID NO: 860

RSLVDCFLVKVGDLCDFFNW SEQ ID NO: 861

RYLYDCFLALVGDLCVKFHQ SEQ ID NO: 862

SEQ ID NO: 863
A H F Y D C F W A K A G E L C D L W P S

SEQ ID NO: 864
K W F H D C F L A K V G D L C D L F L W

SEQ ID NO: 865
W G K L V R D C F L A K V G D L C D L F L W

SEQ ID NO: 866
T H V H D C F L A K V G D L C D L F I V

SEQ ID NO: 867
H W V R D C F L A K V G E L C D L F L W

SEQ ID NO: 868
H G I L D C Y F A K V G E L C E L F D W

SEQ ID NO: 869
Q F V K D C F L A Q V G D L C E L F L W

SEQ ID NO: 870
D W L P D C Y F A N V G D L C S L F G S

SEQ ID NO: 871
H W F L D C F L A N V G D L C D F F G N

SEQ ID NO: 872
N W L P D C L F A N V G E L C D I F P W

SEQ ID NO: 873
E I F K D C L F A N V G E L C E I F P S

SEQ ID NO: 874
N W F H D C F L A R V G D L C D L F L D

SEQ ID NO: 875
Y S F K D C Y F A K V G E L C E L F L W

SEQ ID NO: 876
E F F H D C Y V A R V G E L C D L F G W

SEQ ID NO: 877
S Y L C W L D H W G V I C E E D

SEQ ID NO: 878
W Y T C M M D W L G V H C E L E

SEQ ID NO: 879
Q M V W W D C W S T Q E G P V C E L N W T A

SEQ ID NO: 880
Y W C S V W Q L G S V C E M N N E E T Q

SEQ ID NO: 881
W T C W L T Q L G Y D C N L D V V D Q S L G

SEQ ID NO: 882
D G S W Y T C W F T Q L G E W C E Q D D A K

SEQ ID NO: 883
E F W G W Q C W Q E P L G W S C D L E W M D

SEQ ID NO: 884
W Y P C W I A R V G E L C D L E

SEQ ID NO: 885
W Y P C W L A Q V G E L C D L D

SEQ ID NO: 886
L V D C F K V K V G E L C D L F

SEQ ID NO: 887
V H D C F I A Q V G D L C D L F

SEQ ID NO: 888
W P C W A A L G E L C D L D

SEQ ID NO: 889
W P C W A L G E L C D L D

SEQ ID NO: 890
W P C W L G E L C D L D

SEQ ID NO: 891
W Y P C W G E L C D L D

An IL-2Rβ ligand provided by the present disclosure can comprise a truncated amino acid sequence of any one of SEQ ID NOS: 661-891.

An IL-2Rβ ligand provided by the present disclosure can comprise an amino acid sequence selected from any one of SEQ ID NOS: 661-891, or a truncated amino acid sequence of any one of SEQ ID NOS: 661-891, wherein the amino acid sequence can independently comprise from 1 to 4 glycines (G) (SEQ ID NO: 9615) on the N-terminus, on the C-terminus, or on both the N- and C-termini.

An IL-2Rβ ligand provided by the present disclosure can comprise an amino acid sequence selected from any one of SEQ ID NOS: 661-891, or a truncated amino acid sequence of any one of SEQ ID NOS: 661-891, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 661-891 or to a truncated amino acid sequence of any one of SEQ ID NOS: 661-891.

An IL-2Rβ ligand of anyone of SEQ ID NOS: 661-891, a truncated IL-7Rα ligand of anyone of SEQ ID NOS: 661-891, or a substituted IL-7Rα ligand of any one of SEQ ID NOS: 661-891 can bind to the hIL-2Rβ subunit with an $IC_{50}$ of less than 100 μM or less than 10 μM as determined using phage ELISA competition assays.

An IL-2Rβ ligand of any one of SEQ ID NOS: 667-891 bound to the hIL-2Rβ subunit with an $IC_{50}$ of less than 100 μM as determined using phage ELISA competition assays.

An IL-2Rβ ligand provided by the present disclosure can comprise the amino acid sequence of Formula (9) (SEQ ID NO: 900), an amino acid sequence of Formula (9a) (SEQ ID NO: 901), an amino acid sequence of Formula (9b) (SEQ ID NO: 902), an amino acid sequence of Formula (9c) (SEQ ID NO: 903), an amino acid sequence of Formula (9d) (SEQ ID NO: 904), an amino acid sequence of Formula (9e) (SEQ ID NO: 905), an amino acid sequence of Formula (9f) (SEQ ID NO: 906), an $$-X^1-X^2-X^3-X^4-X^5-C-X^6-X^7-X^8-X^9-X^{10}-X^{11}-X^{12}-X^{13}-C-X^{14}-X^{15}-X^{16}-X^{17}-X^{18}- \quad (9)$$

$$-X^2-X^3-X^4-X^5-C-X^6-X^7-X^8-X^9-X^{10}-X^{11}-X^{12}-X^{13}-C-X^{14}-X^{15}-X^{16}-X^{17}- \quad (9a)$$

$$-X^3-X^4-X^5-C-X^6-X^7-X^8-X^9-X^{10}-X^{11}-X^{12}-X^{13}-C-X^{14}-X^{15}-X^{16}- \quad (9b)$$

$$-X^4-X^5-C-X^6-X^7-X^8-X^9-X^{10}-X^{11}-X^{12}-X^{13}-C-X^{14}-X^{15}- \quad (9c)$$

$$-X^5-C-X^6-X^7-X^8-X^9-X^{10}-X^{11}-X^{12}-X^{13}-C-X^{14}- \quad (9d)$$

$$-C-X^6-X^7-X^8-X^9-X^{10}-X^{11}-X^{12}-X^{13}-C- \quad (9e)$$

$$-X^6-X^7-X^8-X^9-X^{10}-X^{11}-X^{12}-X^3- \quad (9f)$$

wherein,
X$^1$ can be selected from A, D, E, H, K, N, Q, R, and T;
X$^2$ can be selected from F, G, H, I, L, S, W, and Y;
X$^3$ can be selected from F, I, L, and V;
X$^4$ can be selected from H. K, L, P, R, V, and Y;
X$^5$ can be D;
X$^6$ can be selected from F, L, and Y;
X$^7$ can be selected from F, I, K, L, V, and W;
X$^8$ can be selected from A and V;
X$^9$ can be selected from K, L, N, Q, and R;
X$^{10}$ can be selected from A and V;
X$^{11}$ can be G;
X$^{12}$ can be selected from D and E;
X$^{13}$ can be selected from L, T, and V;
X$^{14}$ can be selected from D, E, S, and V;
X$^{15}$ can be selected from F, I, K, and L;
X$^{16}$ can be selected from F and W;
X$^{17}$ can be selected from D, F, G, I, L, N, P, and V; and
X$^{18}$ can be selected from D, G, H, N, Q, S V, and W.

In an IL-2Rβ ligand of Formula (9)-(9f), X$^2$ can be W.
In an IL-2Rβ ligand of Formula (9)-(9f), X$^6$ can be F.
In an IL-2Rβ ligand of Formula (9)-(9f), X$^7$ can be selected from F and L.
In an IL-2Rβ ligand of Formula (9)-(9f), X$^8$ can be A.
In an IL-2Rβ ligand of Formula (9)-(9f), X$^9$ can be K.
In an IL-2Rβ ligand of Formula (9)-(9f), X$^{10}$ can be V.
In an IL-2Rβ ligand of Formula (9)-(9f), X$^{13}$ can be L.
In an IL-2Rβ ligand of Formula (9)-(9f), X$^{14}$ can be D.
In an IL-2Rβ ligand of Formula (9)-(9f), X$^{15}$ can be L.
In an IL-2Rβ ligand of Formula (9)-(9f), X$^{16}$ can be F.
In an IL-2Rβ ligand of Formula (9)-(9f), X$^{17}$ can be L.
In an IL-2Rβ ligand of Formula (9)-(9f), X$^{18}$ can be W.
In an IL-2Rβ ligand of Formula (9)-(9f), the IL-2Rβ ligand can be defined by any combination of X$^1$ to X$^{18}$ as defined in the immediately preceding thirteen (13) paragraphs.

An IL-2Rβ ligand can comprise the amino acid sequence of any one of SEQ ID NO: 907-926:

```
                                       SEQ ID NO: 907
A F F H D C F F A K A G D L C D F F D D

SEQ ID NO: 908
D F F H D C F F A K V G D L C D F F F G

SEQ ID NO: 909
E G F H D C F F A K V G D L C D I F G H

SEQ ID NO: 910
E H F H D C F F A K V G D L C D I F G N

SEQ ID NO: 911
E H F H D C F F A K V G D L C D K F G Q

SEQ ID NO: 912
H I F H D C F I A K V G D L C D L F H S

SEQ ID NO: 913
H L F H D C F K A K V G D L C D L F I S

SEQ ID NO: 914
H L F K D C F L A K V G D L C D L F L S

SEQ ID NO: 915
W G K S I K D C F L A K V G D L C D L F L V

SEQ ID NO: 916
K S L K D C F L A K V G D L C D L F L V

SEQ ID NO: 917
K W L L D C F L A L V G D L C D L F L W

SEQ ID NO: 918
N W L L D C F L A N V G D L C D L F L W

SEQ ID NO: 919
N W L P D C F L A N V G E L C D L F L W

SEQ ID NO: 920
Q W L P D C F L A N V G E L C D L F L W

SEQ ID NO: 921
Q W V R D C L L A N V G E L C E L F L W

SEQ ID NO: 922
R W V R D C L L A Q V G E L C E L F N W

SEQ ID NO: 923
R W V V D C Y L A Q V G E L C E L F P W

SEQ ID NO: 924
R W V V D C Y L A R V G E L C E L F P W

SEQ ID NO: 925
T Y V Y D C Y V V R V G E T C S L F P W

SEQ ID NO: 926
Y Y V Y N C Y W V R V G E V C V L W V W
```

An IL-2Rβ ligand provided by the present disclosure can comprise a truncated amino acid sequence of any one of SEQ ID NOS: 900-926.

An IL-2Rβ ligand provided by the present disclosure can comprise an amino acid sequence selected from any one of SEQ ID NOS: 900-926, or a truncated amino acid sequence of any one of SEQ ID NOS: 900-926, wherein the amino acid sequence can independently comprise from 1 to 4 glycines (G) (SEQ ID NO: 9615) on the N-terminus, on the C-terminus, or on both the N- and C-termini.

An IL-2Rβ ligand provided by the present disclosure can comprise an amino acid sequence selected from any one of SEQ ID NOS: 900-926, or a truncated amino acid sequence of any one of SEQ ID NOS: 900-926, wherein the amino acid sequence comprises one or more amino acid substitutions such as from 1 to 5 amino acid substitutions. The amino acid substitutions can comprise conservative amino acid substitutions.

An IL-2Rβ ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 900-926 or to a truncated amino acid sequence of any one of SEQ ID NOS: 900-926.

An IL-2Rβ ligand of any one of SEQ ID NOS: 900-926, a truncated IL-2Rβ ligand of any one of SEQ ID NOS: 900-926, or a substituted IL-2Rβ ligand of any one of SEQ ID NOS: 900-926 can bind to the hIL-2Rβ subunit with an IC$_{50}$ of less than 100 μM or less than 10 μM as determined using phage ELISA competition assays.

IL-2Rβ ligands of SEQ ID NOS: 907-926 bound to the hIL-2Rβ subunit with an $IC_{50}$ of less than 100 μM as determined using phage ELISA competition assays.

Certain IL-2Rβ ligands of anyone of SEQ ID NOS: 575-655, 661-891, and 900-926, a truncated IL-2Rβ ligand of any one of SEQ ID NOS: 575-655, 661-891, and 900-926, or a substituted IL-2Rβ ligand of any one of SEQ ID NOS: 575-655, 661-891, and 900-926 can bind to the cyno-IL-2Rβ subunit with an $IC_{50}$ of less than 100 μM or less than 10 μM as determined using phage ELISA competition assays.

Certain IL-2Rβ ligands of SEQ ID NOS: 575-655, 661-891, and 900-926 bound to the cyno-IL-2Rβ subunit with an $IC_{50}$ of less than 100 μM as determined using phage ELISA competition assays.

An IL-2Rβ ligand can have the amino acid sequence of any of SEQ ID NOS: 930-939:

SEQ ID NO: 930
G G W Y P C W I A R V G E L C D L E E G P V N R

SEQ ID NO: 931
G G A V E F Y P C W L A R I G E L C D L V E P

SEQ ID NO: 932
G G W Y P C W I A R V G E L C D M E

SEQ ID NO: 933
G G E W F H D C F L A K V G D L C D L F L G G E W

SEQ ID NO: 934
G G R Y V H D C F I A Q V G D L C D L F L H

SEQ ID NO: 935
G G R S L V D C F L V K V G D L C D F F N W

SEQ ID NO: 936
G G W Y P C W I A R V G E L C D L E

SEQ ID NO: 937
G G W Y P C W L A Q V G E L C D L D

SEQ ID NO: 938
G G L V D C F K V K V G E L C D L F

SEQ ID NO: 939
G G W Y S C W M A Q L G E L C D L D

Certain IL-2Rβ ligands provided by the present disclosure can bind to a specific binding site on the IL-2Rβ subunit that is different from the binding site on the IL-2Rβ subunit to which IL-2 binds.

IL-2Rβ ligands having SEQ ID NOS: 154, 180, and 209 do not bind competitively with IL-2 binding to IL-2Rβ, indicating that the IL-2Rβ ligand binding site for these compounds is distinct from that of IL-2. This group of IL-2Rβ ligands bind to a specific binding site on the IL-2Rβ subunit with an $IC_{50}$ of less than 10 μM.

Specific binding sites on the IL-2Rβ subunit can be characterized by at least the following properties: (1) a group of IL-2Rβ ligands bind to each specific binding site on the IL-2Rβ subunit with an $IC_{50}$ of less than 10 μM; (2) each of the IL-2Rβ ligands within the group competitively bind to the specific binding site on the IL-2Rβ subunit with each of the other IL-2Rβ ligands within the group; (3) a peptide having the amino acid sequence of SEQ ID NO: 219 does not compete for binding to a specific binding site on the IL-2Rβ subunit with the peptides within the group of IL-2Rβ ligands; and (4) IL-2Rβ ligands having SEQ ID NOS: 154, 180, and 209 do not bind competitively with IL-2 binding to IL-2Rβ, indicating that this IL-2Rβ ligand binding site is distinct from that of IL-2.

The group of IL-2Rβ ligands comprises at least the IL-2Rβ ligands having the amino acid sequence of any one of SEQ ID NOS: 154, 180, and 209.

The specific binding site of the IL-2Rβ subunit for these IL-2Rβ ligands can be characterized using competitive binding assays as described, for example, in Example 38.

Amino acid sequences having SEQ ID NO: 9501-9609 are excluded from the scope of the amino acid sequences according to the present invention. In a genus or sub-genus of amino acid sequences that otherwise encompasses any one of SEQ ID NO: 9501-9609, the amino acid sequence of SEQ ID NO: 9501-9609 are not included within the scope of the genus or sub-genus.

SEQ ID NO: 9501
A R S D Y G L G A I W P

SEQ ID NO: 9502
F P V P R W G D W G D L I E L

SEQ ID NO: 9503
G V Q S R W G D V G D L I P W

SEQ ID NO: 9504
G T Q E A C F G L L

SEQ ID NO: 9505
H C L D M G C T F P V W

SEQ ID NO: 9506
I S A G R W G D V G D L I P

SEQ ID NO: 9507
I D C G V A T V G E L C

SEQ ID NO: 9508
I S C S E A G L G E L C

SEQ ID NO: 9509
I D C S Q A M L G E L C

SEQ ID NO: 9510
I D C S E A W L G E L C

SEQ ID NO: 9511
I D C S E A A L G T L C

SEQ ID NO: 9512
I D C S E A G L G E L C

SEQ ID NO: 9513
I D C S E A A L G E L C

SEQ ID NO: 9514
I N C S E A V I G Q L C

SEQ ID NO: 9515
I D C S N A V V G Q L C

SEQ ID NO: 9516
I D C S A A G L G E L C

SEQ ID NO: 9517
I D C G V A T V G E L C

SEQ ID NO: 9518
I D C S E A A L G E L C

SEQ ID NO: 9519
I N C S E A V I G D L C

SEQ ID NO: 9520
I D C S Q A M L G E L C

SEQ ID NO: 9521
I D C S E A V L G E L C

SEQ ID NO: 9522
I D C S A A G L G E L C

SEQ ID NO: 9523
I D C S E A A L G T L C

SEQ ID NO: 9524
I S C S E A G L G E L C

SEQ ID NO: 9525
I S C S E A G L G E L C

SEQ ID NO: 9526
I D C S N A V V G Q L C

SEQ ID NO: 9527
L D C S I A A L G E L C

-continued

L D C S E A I L G Q L C

SEQ ID NO: 9528
L D C G E A I L G E L C

SEQ ID NO: 9529
L D C R D A V L G E L C

SEQ ID NO: 9530
L D C S R A S L G E L C

SEQ ID NO: 9531
L D C S N A G W G D L C

SEQ ID NO: 9532
L D C S E A V L G E L C

SEQ ID NO: 9533
L D C H L A V L G E L C

SEQ ID NO: 9534
L D C S V A V L G E L C

SEQ ID NO: 9535
L D C S E A W L G H L C

SEQ ID NO: 9536
L D C S N A G V G D L C

SEQ ID NO: 9537
L D C S I A A L G E L C

SEQ ID NO: 9538
L D C S E A I L G Q L C

SEQ ID NO: 9539
L D C H L A V L G E L C

SEQ ID NO: 9540
L D C S V A V L G E L C

SEQ ID NO: 9541
L D C R D A V L G E L C

SEQ ID NO: 9542
L D C S E A V L G E L C

SEQ ID NO: 9543
L D C G E A I L G E L C

SEQ ID NO: 9544
L D C S E A V L G H L C

SEQ ID NO: 9545
M D C S E R A L G E L C

SEQ ID NO: 9546
M D C S Q A G L G E L C

SEQ ID NO: 9547
M D C R E A A L G E L C

SEQ ID NO: 9548
M D C W E A A L G E L C

SEQ ID NO: 9549
M D C S E A L L G E L C

SEQ ID NO: 9550
M D C Y D A R L G D L C

SEQ ID NO: 9551
M D S S Q A A L G E L C

SEQ ID NO: 9552
M D C S Q A G L G E L C

SEQ ID NO: 9553
M D C S Q A A L G D L C

SEQ ID NO: 9554
M D C S W A W L G D L C

SEQ ID NO: 9528
M D C S D A V L G D L C

SEQ ID NO: 9529
M D C H E A A L G H L C

SEQ ID NO: 9530
M D C S Q A V L G E L C

SEQ ID NO: 9531
M D C S I R A L G E L C

SEQ ID NO: 9532
M D C R W A A L G E L C

SEQ ID NO: 9533
M D C S K A A L G E L C

SEQ ID NO: 9534
M D C S E A V L G E L C

SEQ ID NO: 9535
M D C S I R A L G E L C

SEQ ID NO: 9536
M D C S E R A L G E L C

SEQ ID NO: 9537
M D C S E R A L G E L C

SEQ ID NO: 9538
M D C S Q A A L G D L C

SEQ ID NO: 9539
M D C S V A V L G D L C

SEQ ID NO: 9540
M D C R E A A L G E L C

SEQ ID NO: 9541
M D C W E A A L G E L C

SEQ ID NO: 9542
M D C H E A A L G H L C

SEQ ID NO: 9543
M D C S Q A V L G E L C

SEQ ID NO: 9544
M D C Y D A R L G D L C

SEQ ID NO: 9545
M D S S Q A A L G E L C

SEQ ID NO: 9546
M D C S E A V L G E L C

SEQ ID NO: 9547
M D C S Q A A L G D L C

SEQ ID NO: 9548
M D C S Q A G L G E L C

SEQ ID NO: 9549
M D C S Q A G L C E L C

SEQ ID NO: 9550
M D C S D A V L G D L C

SEQ ID NO: 9551
M D C S E A L L G E L C

SEQ ID NO: 9552
R W G D V G D L I G

SEQ ID NO: 9553
R W G D V G D L I W

SEQ ID NO: 9554

SEQ ID NO: 9555

SEQ ID NO: 9556

SEQ ID NO: 9557

SEQ ID NO: 9558

SEQ ID NO: 9559

SEQ ID NO: 9560

SEQ ID NO: 9561

SEQ ID NO: 9562

SEQ ID NO: 9563

SEQ ID NO: 9564

SEQ ID NO: 9565

SEQ ID NO: 9566

SEQ ID NO: 9567

SEQ ID NO: 9568

SEQ ID NO: 9569

SEQ ID NO: 9570

SEQ ID NO: 9571

SEQ ID NO: 9572

SEQ ID NO: 9573

SEQ ID NO: 9574

SEQ ID NO: 9575

SEQ ID NO: 9576

SEQ ID NO: 9577

SEQ ID NO: 9578

SEQ ID NO: 9579

SEQ ID NO: 9580

SEQ ID NO: 9581

-continued

| Sequence | SEQ ID NO |
|---|---|
| R W G D V G D L I G | 9582 |
| R W G D V G D L I V | 9583 |
| R W G D V G D L V S | 9584 |
| R W G D V G D L V M | 9585 |
| R W G D V G D M V E | 9586 |
| R Y G E V G D L L P | 9587 |
| R W G D W G D L L P | 9588 |
| R W G D W G D L I P | 9589 |
| R W G D W G D L V A | 9590 |
| R W G D W G D L V E | 9591 |
| R W G D W G D L V W | 9592 |
| R W G D W G D L V G | 9593 |
| R W G D V G D L V P | 9594 |
| R W G D W G D M V V | 9595 |
| R A C R V M P C L P D L | 9596 |
| S G C G R E L G W C | 9597 |
| T E C S E A G L W E L C | 9598 |
| T E C S E A G L W E L C | 9599 |
| T E C S E A G L W E L C | 9600 |
| T Q E V Y Y S L L | 9601 |
| V D C S E A V L G Q L C | 9602 |
| V D C S E A V L G Q L C | 9603 |
| W S G P G I L G E Y M | 9604 |
| W D G P G L G E F F | 9605 |
| W S G P G I L G E F M | 9606 |
| W Y G P G I L G E Y M | 9607 |
| W E G P G L G E Y M | 9608 |
| W E G P G I L G E Y | 9609 |

An Rγc ligand provided by the present disclosure comprises an Rγc ligand of any one of SEQ ID NOS: 1001-1215, a truncated amino acid sequence of any one of SEQ ID NOS: 1001-1215, a substituted amino acid sequence of any one of SEQ ID NOS: 1001-1215, or an amino acid sequence having a sequence similarity greater than greater than 60%, greater than 70%, greater than 75%, greater than 80%, greater than 85%, greater than 90%, or greater than 95% to any of the foregoing.

An Rγc ligand provided by the present disclosure can bind to the human Rγc subunit of IL-2R and IL-7R with an $IC_{50}$ of less than 100 μM, less than 10 μM, less than 1 μM, less than 0.1 μM, or less than 0.01 μM.

An Rγc ligand provided by the present disclosure can bind to the human Rγc subunit of IL-2R and IL-7R with an $IC_{50}$ from 1 pM to 100 μM, from 10 pM to 10 μM, from 100 pM to 1 μM, from 0.001 μM to 1 μM, or from 0.01 μM to 1 μM.

An Rγc ligand provided by the present disclosure can bind to the human Rγc subunit of IL-2R and IL-7R with an $IC_{50}$, for example, of less than 100 μM, less than 10 μM, less than 1 μM, less than 0.1 μM, or less than 0.01 μM.

An Rγc ligand provided by the present disclosure can bind to the human Rγc subunit of IL-2R and IL-7R with an $IC_{50}$, for example, from 1 pM to 100 μM, from 10 pM to 10 μM, from 100 μM to 1 μM, from 0.001 μM to 1 μM, or from 0.01 μM to 1 μM.

An Rγc ligand provided by the present disclosure can comprise an amino acid sequence selected from any one of SEQ ID NOS: 1001-1215.

An Rγc ligand can comprise an amino acid sequence of Formula (11) (SEQ ID NO: 1001), an amino acid sequence of Formula (11a) (SEQ ID NO: 1002), an amino acid sequence of Formula (11b) (SEQ ID NO: 1003), or the amino acid sequence of Formula (11c) (SEQ ID NO: 1004):

$$-X^3-X^4-X^5-X^6-X^7-X^8-X^9-X^{10}- \quad (11)$$

$$-C-X^3-X^4-X^5-X^6-X^7-X^8-X^9-X^{10}-C- \quad (11a)$$

$$-X^2-C-X^3-X^4-X^5-X^6-X^7-X^8-X^9-X^{10}-C-X^{11}- \quad (11b)$$

$$-X^1-X^2-C-X^3-X^4-X^5-X^6-X^7-X^8-X^9-X^{10}-C-X^{11}-X^{12}- \quad (11c)$$

wherein,
$X^1$ can be selected from G, I, K, L, Q, R, T, Y, and V;
$X^2$ can be selected from A, D, E, H, I, L, M, R, S, T, V, and W;
$X^3$ can be selected from D, E, F, N, Q, S, and T;
$X^4$ can be selected from A, D, E, G, I, M, N, Q, R, S, and T;
$X^5$ can be selected from D, E, F, Q, S, T, W, and Y;
$X^6$ can be selected from D, E, F, G, L, M, N, Q, and Y;
$X^7$ can be selected from E, G, N, S and Q;
$X^8$ can be selected from I, K, M, P, T, and V;
$X^9$ can be selected from I, L, M, S, T, and V;
$X^{10}$ can be selected from F, I, and L;
$X^{11}$ can be selected from F, T, and W; and
$X^{12}$ can be selected from A, E, F, G, I, K, L, M, N, P, Q, S, T, V, W, and Y.

In Rγc ligands of Formula (11)-(11c), $X^1$ can be selected from I, L, and V.

In Rγc ligands of Formula (11)-(11c), $X^2$ can be selected from S and T.

In Rγc ligands of Formula (11)-(11c), $X^3$ can be selected from D, E, N, and Q.

In Rγc ligands of Formula (11)-(11c), $X^1$ can be selected from D, E, N, and Q.

In Rγc ligands of Formula (11)-(11c), $X^5$ can be selected from F, W, and Y.

In Rγc ligands of Formula (11)-(11c), $X^6$ can be selected from D, E, N, and Q.

In Rγc ligands of Formula (11)-(11c), $X^7$ can be G.

In Rγc ligands of Formula (11)-(11c), $X^8$ can be selected from I and V.

In Rγc ligands of Formula (11)-(11c), $X^9$ can be selected from I, L, M, and V.

In Rγc ligands of Formula (11)-(11c), $X^{10}$ can be selected from F, I, and L.

In Rγc ligands of Formula (11)-(11c), $X^{11}$ can be W.

In Rγc ligands of Formula (11)-(11c), $X^{12}$ can be selected from N and Q.

In Rγc ligands of Formula (11)-(11c), the Rγc ligand can be defined by any combination of $X^1$-$X^{11}$ as defined in the immediately preceding thirteen (13) paragraphs.

In Rγc ligands of Formula (11)-(11c),
$X^1$ can be selected from I, L, and V;
$X^2$ can be selected from S and T;
$X^3$ can be selected from D, E, N, and Q;
$X^4$ can be selected from D and N;
$X^5$ can be selected from F, W, and Y;
$X^6$ can be selected from D, E, N, and Q;
$X^7$ can be G;
$X^8$ can be selected from I and V;
$X^9$ can be selected from I, L, M, and V;
$X^{10}$ can be selected from F, I, and L;
$X^{11}$ can be W; and
$X^{12}$ can be selected from N and Q.

An Rγc ligand can comprise an amino acid sequence selected from any one of SEQ ID NOS: 1005-1029:

```
G T C Q E Y N G V M I C W G                SEQ ID NO: 1005

I E C N R D E C P M I C W A                SEQ ID NO: 1006

I A C S Q E M G I L L C W V                SEQ ID NO: 1007

I H C N S Q M G I L I C W Y                SEQ ID NO: 1008

I M C D S S S G V S I C W T                SEQ ID NO: 1009

I T C Q T F N G V P L C W K                SEQ ID NO: 1010

K V C E M W G G V L L C W N                SEQ ID NO: 1011

K W C Q D W F G V L L C T V                SEQ ID NO: 1012

L E C N N S Y G V L L C W S                SEQ ID NO: 1013

L T C Q N W Q G V S L C W N                SEQ ID NO: 1014

L V C D D T L G V T L C W W                SEQ ID NO: 1015

L E C D A S M S V M I C W F                SEQ ID NO: 1016

L D C D T S M G V P L C W F                SEQ ID NO: 1017

Q L C Q I W Q E V L L C W P                SEQ ID NO: 1018

R I C Q D F Q G V I L C W L                SEQ ID NO: 1019

R R C Q D Y L G I L L C W E                SEQ ID NO: 1020

R T C T E W E N V V L C W V                SEQ ID NO: 1021

R V C Q D W L G V K L C W N                SEQ ID NO: 1022

T S C F N F D G V L L C W Q                SEQ ID NO: 1023

V S C E S W Q G T L F C W Q                SEQ ID NO: 1024

V T C Q D W N G V L L C F P                SEQ ID NO: 1025

V S C D G S S G V L L C W M                SEQ ID NO: 1026

V T C Q T W N Q V L L C W S                SEQ ID NO: 1027

V M C E D W G G V P I C W I                SEQ ID NO: 1028

Y L C D E S M G V K L C W F                SEQ ID NO: 1029
```

An Rγc ligand provided by the present disclosure can comprise a truncated amino acid sequence of any one of SEQ ID NOS: 1001-1029.

An Rγc ligand provided by the present disclosure can comprise an amino acid sequence selected from any one of SEQ ID NOS: 1001-1029, or a truncated amino acid sequence of any one of SEQ ID NOS: 1001-1029, wherein the amino acid sequence can independently comprise from 1 to 4 glycines (G) (SEQ ID NO: 9615) on the N-terminus, on the C-terminus, or on both the N- and C-termini.

An Rγc ligand provided by the present disclosure can comprise an amino acid sequence selected from any one of SEQ ID NOS: 1001-1029, or a truncated amino acid sequence of any one of SEQ ID NOS: 1001-1029, wherein the amino acid sequence comprises one or more amino acid substitutions such as from 1 to 5 amino acid substitutions. The amino acid substitutions can comprise conservative amino acid substitutions.

An Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 1001-1029 or a truncated amino acid sequence of any one of SEQ ID NOS: 1001-1029.

An Rγc ligand of any one of SEQ ID NOS: 1001-1029, a truncated Rγc ligand of any one of SEQ ID NOS: 1001-1029, or a substituted Rγc ligand of any one of SEQ ID NOS: 1001-1029 can bind to the hRγc subunit with an $IC_{50}$ of less than 100 μM or less than 10 μM as determined using phage ELISA competition assays.

An Rγc ligand of any one of SEQ ID NOS: 1005-1029 bind to the hRγc subunit with an $IC_{50}$ of less than 100 μM.

An Rγc ligand can comprise an amino acid sequence of Formula (11) (SEQ ID NO: 1001), an amino acid sequence of Formula (11a) (SEQ ID NO: 1002), an amino acid sequence of Formula (11b) (SEQ ID NO: 1003) or an amino acid sequence of Formula (11c) (SEQ ID NO: 1004):

$$-X^3-X^4-X^5-X^6-X^7-X^8-X^9-X^{10}- \quad (11)$$

$$-C-X^3-X^4-X^5-X^6-X^7-X^8-X^9-X^{10}-C- \quad (11a)$$

$$-X^2-C-X^3-X^4-X^5-X^6-X^7-X^8-X^9-X^{10}-C-X^{11}- \quad (11b)$$

$$-X^1-X^2-C-X^3-X^4-X^5-X^6-X^7-X^8-X^9-X^{10}-C-X^{11}-X^{12}- \quad (11c)$$

wherein, $X^1$ can be selected from an amino acid;

$X^2$ can be selected from an amino acid;

$X^3$ can be selected from an amino acid comprising a polar-neutral side chain or an acidic side chain;

$X^4$ can be selected from an amino acid comprising a polar-neutral side chain or an acidic side chain;

$X^5$ can be selected from an amino acid;

$X^6$ can be selected from an amino acid;

$X^7$ can be selected from an amino acid comprising a small hydrophobic side chain;

$X^8$ can be selected from an amino acid comprising a large hydrophobic side chain;

$X^9$ can be selected from an amino acid comprising a large hydrophobic side chain;

$X^{10}$ can be selected from an amino acid comprising a large hydrophobic side chain;

$X^{11}$ can be selected from an amino acid comprising a large hydrophobic side chain; and $X^{12}$ can be selected from an amino acid.

In Rγc ligands of Formula (11)-(11c), $X^1$ can be selected from an amino acid comprising a large hydrophobic side chain and a basic side chain;

$X^2$ can be selected from an amino acid comprising a hydroxyl-containing side chain and a large hydrophobic side chain;

$X^3$ can be selected from an amino acid comprising a polar-neutral side chain or an acidic side chain;

$X^4$ can be selected from an amino acid comprising a polar-neutral side chain or an acidic side chain;

$X^5$ can be selected from an amino acid comprising a large hydrophobic side chain;

$X^6$ can be selected from an amino acid comprising a polar-neutral side chain or an acidic side chain;

$X^7$ can be selected from an amino acid comprising a small hydrophobic side chain;

$X^8$ can be selected from an amino acid comprising a large hydrophobic side chain;

$X^9$ can be selected from an amino acid comprising a large hydrophobic side chain;

$X^{10}$ can be selected from an amino acid comprising a large hydrophobic side chain;

$X^{11}$ can be selected from an amino acid comprising a large hydrophobic side chain; and $X^{12}$ can be selected from an amino acid comprising a polar-neutral side chain.

In Rγc ligands of Formula (11)-(11c), $X^1$ can be selected from R, K, H, F, I, L, M, V, Y, and W;

$X^2$ can be selected from S, T, F, I, L, M, V, Y, and W;

$X^3$ can be selected from D, E, H, N, Q, S, T, and Y;

$X^4$ can be selected from D, E, H, N, Q, S, T, and Y;

$X^5$ can be selected from F, I, L, M, V, Y, and W;

$X^6$ can be selected from D, E, H, N, Q, S, T, and Y;

$X^7$ can be selected from A, G, P, S, and T;

$X^8$ can be selected from F, I, L, M, V, Y, and W;

$X^9$ can be selected from F, I, L, M, V, Y, and W;

$X^{10}$ can be selected from F, I, L, M, V, Y, and W;

$X^{11}$ can be selected from F, I, L, M, V, Y, and W; and $X^{12}$ can be selected from H, N, Q, S, T, and Y.

In Rγc ligands of Formula (11)-(11c), $X^1$ can be selected from I, L, and V.

In Rγc ligands of Formula (11)-(11c), $X^2$ can be selected from S and T.

In Rγc ligands of Formula (11)-(11c), $X^3$ can be selected from D, E, and Q.

In Rγc ligands of Formula (11)-(11c), $X^4$ can be selected from D, E, and N.

In Rγc ligands of Formula (11)-(11c), $X^5$ can be selected from F, Y, and W.

In Rγc ligands of Formula (11)-(11c), $X^6$ can be selected from D, E, N, and Q.

In Rγc ligands of Formula (11)-(11c), $X^7$ can be G.

In Rγc ligands of Formula (11)-(11c), $X^8$ can be selected from I and V.

In Rγc ligands of Formula (11)-(11c), $X^9$ can be selected from I, L, M, and V.

In Rγc ligands of Formula (11)-(11c), $X^{10}$ can be selected from F, I, and L.

In Rγc ligands of Formula (11)-(11c), $X^{11}$ can be W.

In Rγc ligands of Formula (11)-(11c), $X^{12}$ can be selected from N and Q.

In Rγc ligands of Formula (11)-(11c), the Rγc ligand can be defined by any combination of $X^1$-$X^{12}$ as defined in the immediately preceding thirteen (13) paragraphs.

In Rγc ligands of Formula (11)-(11c), $X^1$ can be selected from I, L, and V;

$X^2$ can be selected from S and T;

$X^3$ can be selected from D, E, and Q;

$X^4$ can be selected from D, E, and N;

$X^5$ can be selected from F, Y, and W;

$X^6$ can be selected from D, E, N, and Q;

$X^7$ can be G;

$X^8$ can be selected from I and V;

$X^9$ can be selected from I, L, M, and V;

$X^{10}$ can be selected from F, I, and L;

$X^{11}$ can be W; and $X^{12}$ can be selected from N and Q.

In Rγc ligands of Formula (11)-(11c), $X^1$ can be selected from G, I, K, L, Q, R, and V;

$X^2$ can be selected from A, D, E, H, I, L, M, R, S, T, V, and W;

$X^3$ can be selected from D, E, F, N, Q, S, and T;

$X^4$ can be selected from A, D, E, G, I, M, N, R, S, and T;

$X^5$ can be selected from D, E, F, Q, S, T, W, and Y;

$X^6$ can be selected from D, E, F, G, L, M, N, Q, S, and Y;

$X^7$ can be selected from C, E, G, N, Q, and S;

$X^8$ can be selected from I, P, T, and V;

$X^9$ can be selected from I, K, L, M, P, S, T, and V;

$X^{10}$ can be selected from F, I, and L;

$X^{11}$ can be selected from F, T, and W; and $X^{12}$ can be selected from A, E, F, G, I, K, L, M, N, P, Q, S, T, V, W, and Y.

In Rγc ligands of Formula (11)-(11c), $X^1$ can be selected from I, L, and V;

$X^2$ can be selected from S and T;

$X^3$ can be selected from D, E, N, and Q;

$X^4$ can be selected from D, E, N, S, and T;

$X^5$ can be selected from F, S, T, W, and Y;

$X^6$ can be selected from D, E, N, and Q;

$X^7$ can be selected from G and N;
$X^8$ can be selected from I and V;
$X^9$ can be selected from I, L, M, and V;
$X^{10}$ can be selected from F, I, and L;
$X^{11}$ can be W; and
$X^{12}$ can be selected from N and Q.

In Rγc ligands of Formula (11)-(11c),
$X^1$ can be selected from I, L, and V;
$X^2$ can be selected from S and T;
$X^3$ can be Q;
$X^4$ can be selected from D, E, N, S, and T;
$X^5$ can be selected from S, T, and W;
$X^6$ can be selected from D, E, N, and Q;
$X^7$ can be G;
$X^8$ can be V;
$X^9$ can be L;
$X^{10}$ can be L;
$X^{11}$ can be W; and
$X^{12}$ can be selected from N and Q.

An Rγc ligand can comprise an amino acid sequence of Formula (12) (SEQ ID NO: 1030), an amino acid sequence of Formula (12a) (SEQ ID NO: 1031), an amino acid sequence of Formula (12b) (SEQ ID NO: 1032) or an amino acid sequence of Formula (12c) (SEQ ID NO: 1033):

  (12)

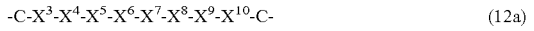  (12a)

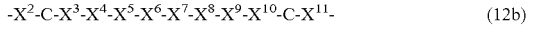  (12b)

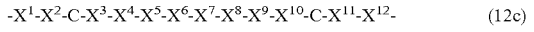  (12c)

wherein,
$X^1$ can be selected from F, G, I, L, P, Q, R, T, and V;
$X^2$ can be selected from A, D, E, I, M, R, S, T, and V;
$X^3$ can be selected from D, E, F, M, N, Q, S T, V, W, and Y;
$X^4$ can be selected from D, E, F, G, I, L, M, P, R, S, T, and V;
$X^5$ can be selected from F, H, L, W, and Y;
$X^6$ can be selected from D, E, H, L, N, Q, S, and T;
$X^7$ can be selected from G, T, Q, and E;
$X^8$ can be selected from I, L, M, Q, and V;
$X^9$ can be selected from D, E, N, Q, and R;
$X^{10}$ can be selected from D, F, I, and L;
$X^{11}$ can be selected from F, I, L, R, T, W, and Y; and
$X^{12}$ can be selected from A, F, G, H, I, L, N, P, Q, S, T, and W.

In Rγc ligands of Formula (12)-(12c), $X^1$ can be selected from I, L, and V.
In Rγc ligands of Formula (12)-(12c), $X^2$ can be selected from A, D, E, I, M, and V.
In Rγc ligands of Formula (12)-(12c), $X^3$ can be selected from E, Q, and N.
In Rγc ligands of Formula (12)-(12c), $X^4$ can be selected from D and E.
In Rγc ligands of Formula (12)-(12c), $X^5$ can be selected from F, W, and Y.
In Rγc ligands of Formula (12)-(12c), $X^6$ can be selected from D, E, L, N, and Q.
In Rγc ligands of Formula (12)-(12c), $X^7$ can be G.
In Rγc ligands of Formula (12)-(12c), $X^8$ can be selected from I, M, and V.
In Rγc ligands of Formula (12)-(12c), $X^9$ can be selected from D, E, Q, and R.
In Rγc ligands of Formula (12)-(12c), $X^{10}$ can be selected from F, I, and L.
In Rγc ligands of Formula (12)-(12c), $X^{11}$ can be W.
In Rγc ligands of Formula (12)-(12c), $X^{12}$ can be selected from N and Q.
In Rγc ligands of Formula (12)-(12c), the Rγc ligand can be defined by any combination of $X^1$-$X^{12}$ as defined in the immediately preceding twelve (12) paragraphs.

In Rγc ligands of Formula (12)-(12c),
$X^1$ can be selected from I, L, and V;
$X^2$ can be selected from A, D, E, I, M, and V;
$X^3$ can be selected from E, Q, and N;
$X^4$ can be selected from D and E;
$X^5$ can be selected from F, W, and Y;
$X^6$ can be selected from D, E, L, N, and Q;
$X^7$ can be G;
$X^8$ can be selected from I, M, and V;
$X^9$ can be selected from D, E, Q, and R;
$X^{10}$ can be selected from F, I, and L;
$X^{11}$ can be W; and
$X^{12}$ can be selected from N and Q.

An Rγc ligand can comprise an amino acid sequence of Formula (12) (SEQ ID NO: 1030), an amino acid sequence of Formula (12a) (SEQ ID NO: 1031), an amino acid sequence of Formula (12b) (SEQ ID NO: 1032) or an amino acid sequence of Formula (12c) (SEQ ID NO: 1033):

  (12)

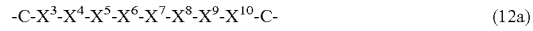  (12a)

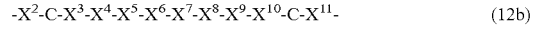  (12b)

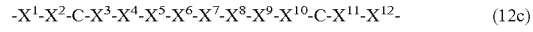  (12c)

wherein,
$X^1$ can be selected from an amino acid;
$X^2$ can be selected from an amino acid;
$X^3$ can be selected from an amino acid;
$X^4$ can be selected from an amino acid;
$X^5$ can be selected from an amino acid comprising a large hydrophobic side chain;
$X^6$ can be selected from an amino acid;
$X^7$ can be selected from a small hydrophobic side chain;
$X^8$ can be selected from an amino acid comprising a large hydrophobic side chain;
$X^9$ can be selected from an amino acid comprising a basic side chain, an acidic side chain, or a polar-neutral side chain;
$X^{10}$ can be selected from an amino acid comprising a large hydrophobic side chain;
$X^{11}$ can be selected from an amino acid comprising a large hydrophobic side chain; and
$X^{12}$ can be selected from an amino acid.

In Rγc ligands of Formula (12)-(12c),
$X^1$ can be selected from an amino acid comprising a large hydrophobic side chain;
$X^2$ can be selected from an amino acid comprising an acidic side chain or a large hydrophobic side chain;
$X^3$ can be selected from an amino acid comprising an acidic side chain, a hydroxyl-containing side chain, or a polar neutral side chain;
$X^4$ can be selected from an amino acid comprising an acidic side chain, a hydroxyl-containing side chain, or a large hydrophobic side chain;
$X^5$ can be selected from an amino acid comprising a large hydrophobic side chain;
$X^6$ can be selected from an amino acid comprising an acidic side chain, a hydroxyl-containing side chain, or a polar neutral side chain;

X⁷ can be selected from a small hydrophobic side chain;

X⁸ can be selected from an amino acid comprising a large hydrophobic side chain;

X⁹ can be selected from an amino acid comprising a basic side chain, an acidic side chain, or a polar-neutral side chain;

X¹⁰ can be selected from an amino acid comprising a large hydrophobic side chain;

X¹¹ can be selected from an amino acid comprising a large hydrophobic side chain; and X¹² can be selected from an amino acid comprising a polar neutral side chain.

In Rγc ligands of Formula (12)-(12c),
X¹ can be selected from F, I, L, M, V, Y, and W;
X² can be selected from D, E, F, I, L, M, V, Y, and W;
X³ can be selected from D, E, S, T, H, N, Q, S, T, and Y;
X⁴ can be selected from D, E, S, T, F, I, L, M, V, Y, and W;
X⁵ can be selected from F, I, L, M, V, Y, and W;
X⁶ can be selected from D, E, S, T, H, N, Q, S, T, and Y;
X⁷ can be selected from A, G, P, S, and T;
X⁸ can be selected from F, I, L, M, V, Y, and W;
X⁹ can be selected from R, K, H, D, E, H, N, Q, S, T, and Y;
X¹⁰ can be selected from F, I, L, M, V, Y, and W;
X¹¹ can be selected from F, I, L, M, V, Y, and W; and
X¹² can be selected from H, N, Q, S, T, and Y.

In Rγc ligands of Formula (12)-(12c), X¹ can be selected from I, L, and V.

In Rγc ligands of Formula (12)-(12c), X² can be selected from D, E, I, M, and V.

In Rγc ligands of Formula (12)-(12c), X³ can be selected from E, N, and Q.

In Rγc ligands of Formula (12)-(12c), X⁴ can be selected from D and E.

In Rγc ligands of Formula (12)-(12c), X⁵ can be selected from F, W, and Y.

In Rγc ligands of Formula (12)-(12c), X⁶ can be selected from D, E, and N.

In Rγc ligands of Formula (12)-(12c), X⁷ can be G.

In Rγc ligands of Formula (12)-(12c), X⁸ can be selected from I, M, and V.

In Rγc ligands of Formula (12)-(12c), X⁹ can be selected from D, E, N, Q, and R.

In Rγc ligands of Formula (12)-(12c), X¹⁰ can be selected from F, I, and L.

In Rγc ligands of Formula (12)-(12c), X¹¹ can be W.

In Rγc ligands of Formula (12)-(12c), X¹² can be selected from N and Q.

In Rγc ligands of Formula (12)-(12c), the Rγc ligand can be defined by any combination of X¹-X¹² as defined in the immediately preceding twelve (12) paragraphs.

In Rγc ligands of Formula (12)-(12c),
X¹ can be selected from I, L, and V;
X² can be selected from D, E, I, M, and V;
X³ can be selected from E, N, and Q;
X⁴ can be selected from D and E;
X⁵ can be selected from F, W, and Y;
X⁶ can be selected from D, E, and N;
X⁷ can be G;
X⁸ can be selected from I, M, and V;
X⁹ can be selected from D, E, N, Q, and R;
X¹⁰ can be selected from F, I, and L;
X¹¹ can be W; and
X¹² can be selected from N and Q.

In Rγc ligands of Formula (12)-(12c),
X¹ can be selected from F, G, I, L, P, Q, R, T, and V;
X² can be selected from A, D, E, I, M, L, M, R, S, T, and V;
X³ can be selected from D, E, F, M, N, Q, S, T, V, W, and Y;
X⁴ can be selected from D, E, F, G, I, L, M, P, R, S, T, and V;
X⁵ can be selected from F, H, L, W, and Y;
X⁶ can be selected from D, E, H, L, N, Q, S, and T;
X⁷ can be selected from E, G, Q, and T;
X⁸ can be selected from I, L, M, Q, and V;
X⁹ can be selected from D, E, N, Q, and R;
X¹⁰ can be selected from D, F, I, and L;
X¹¹ can be selected from C, F, I, L, Q, R, T, W, and Y; and
X¹² can be selected from A, F, G, H, I, L, N, P, Q, S, T, and W.

In Rγc ligands of Formula (12)-(12c),
X¹ can be selected from F, I, L, and V;
X² can be selected from D, E, I, S, T, and V;
X³ can be selected from D, E, N, and Q;
X⁴ can be selected from D, E, F, I, L, M, and V;
X⁵ can be selected from F, W, and Y;
X⁶ can be selected from D, E, N, and Q;
X⁷ can be G;
X⁸ can be selected from I, L, M, and V;
X⁹ can be selected from D, E, N, Q, and R;
X¹⁰ can be selected from D, F, I, and L;
X¹¹ can be selected from F, I, L, and W; and
X¹² can be selected from F, I, L, N, Q, and W.

In Rγc ligands of Formula (12)-(12c),
X¹ can be selected from F, I, L, and V;
X² can be selected from D, E, I, S, T, and V;
X³ can be selected from D, E, N, and Q;
X⁴ can be selected from D, E, F, I, L, M, and V;
X⁵ can be W;
X⁶ can be selected from D, E, N, and Q;
X⁷ can be G;
X⁸ can be V;
X⁹ can be selected from D, E, N, Q, and R;
X¹⁰ can be L;
X¹¹ can be W; and
X¹² can be selected from F, I, L, N, Q, and W.

An Rγc ligand can comprise an amino acid sequence selected from any one of SEQ ID NOS: 1034-1061:

| | |
|---|---|
| D C S M W E G V E L C W | SEQ ID NO: 1034 |
| F T C W D Y N G V D L C Q I | SEQ ID NO: 1035 |
| F S C F I L E T L E L A C W P | SEQ ID NO: 1036 |
| F V C E L W D G I E L C I P | SEQ ID NO: 1037 |
| G A C N P H T Q Q E D C F G | SEQ ID NO: 1038 |
| I E C E F W D G M Q L C W Q | SEQ ID NO: 1039 |
| I L C Q D W S G I E I C W S | SEQ ID NO: 1040 |
| I V C E E W S G V R F C W N | SEQ ID NO: 1041 |
| I E C Q V F H G L E L C W I | SEQ ID NO: 1042 |

LICYTYEGVELCWQ    SEQ ID NO: 1043

LVCSMFNGVDLCWQ    SEQ ID NO: 1044

LDCMDYNGVRLCWN    SEQ ID NO: 1045

LTCVTYEGVDLCWQ    SEQ ID NO: 1046

PRCEIWLGVELCRI    SEQ ID NO: 1047

PACQDWNGVELCIL    SEQ ID NO: 1048

QICQEWSGVNLCWH    SEQ ID NO: 1049

QTCWDYEGMELCLI    SEQ ID NO: 1050

QECTDWQGVELCLL    SEQ ID NO: 1051

RICNDWNGVQLCWP    SEQ ID NO: 1052

TECQVWNGVELCYI    SEQ ID NO: 1053

VDCVIWEGVQLCTW    SEQ ID NO: 1054

VVCTDYLGVQLCWT    SEQ ID NO: 1055

VMCERWQGVELCWL    SEQ ID NO: 1056

VVCQGWSGVDICWQ    SEQ ID NO: 1057

VICQSYDGVEFCWF    SEQ ID NO: 1058

VVCEMYSGVQICWA    SEQ ID NO: 1059

VMCELFDEVELCWF    SEQ ID NO: 1060

VECDVYHGVEICWA    SEQ ID NO: 1061

An Rγc ligand provided by the present disclosure can comprise a truncated amino acid sequence of any one of SEQ ID NOS: 1030-1061.

An Rγc ligand provided by the present disclosure can comprise an amino acid sequence selected from any one of SEQ ID NOS: 1030-1061, or a truncated amino acid sequence of any one of SEQ ID NOS: 1030-1061, wherein the amino acid sequence can independently comprise from 1 to 4 glycines (G) (SEQ ID NO: 9615) on the N-terminus, on the C-terminus, or on both the N- and C-termini.

An Rγc ligand provided by the present disclosure can comprise an amino acid sequence selected from any one of SEQ ID NOS: 1030-1061, or a truncated amino acid sequence of any one of SEQ ID NOS: 1030-1061, wherein the amino acid sequence comprises one or more amino acid substitutions such as from 1 to 5 amino acid substitutions. The amino acid substitutions can comprise conservative amino acid substitutions.

An Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 1030-1061 or to a truncated amino acid sequence of any one of SEQ ID NOS: 1030-1061.

An Rγc ligand of any one of SEQ ID NO: 1030-1061, a truncated Rγc ligand of any one of SEQ ID NOS: 1030-1061, or a substituted Rγc ligand of any one of SEQ ID NOS: 1030-1061 can bind to the hRγc subunit with an $IC_{50}$ of less than 100 μM or less than 10 μM as determined using phage ELISA competition assays.

An Rγc ligand of any one of SEQ ID NOS: 1034-1061 bind to the hRγc subunit with an $IC_{50}$ of less than 100 μM.

An Rγc ligand can comprise an amino acid sequence of Formula (13) (SEQ ID NO: 1062), an amino acid sequence of Formula (13a) (SEQ ID NO: 1063), or an amino acid sequence of Formula (13b) (SEQ ID NO: 1064):

$$-X^3-X^4-X^5-X^6-X^7-X^8-X^9-X^{10}-X^{11}- \quad (13)$$

$$-X^2-X^3-X^4-X^5-X^6-X^7-X^8-X^9-X^{10}-X^{11}-X^{12}- \quad (13a)$$

$$-X^1-X^2-X^3-X^4-X^5-X^6-X^7-X^8-X^9-X^{10}-X^{11}-X^{12}-X^{13}- \quad (13b)$$

wherein,
$X^1$ can be selected from C, D, E, and L;
$X^2$ can be selected from C, L, M, R, S, V, and W;
$X^3$ can be selected from C, D, F, P, and R;
$X^4$ can be selected from A, D, L, Q, S, and W;
$X^5$ can be selected from D, E, F, L, and V;
$X^6$ can be selected from A, D, E, F, G, K, Q, and S;
$X^7$ can be selected from E, L, M, and W;
$X^8$ can be selected from G, I, L, W, and Y;
$X^9$ can be selected from E, I, R, T, and V;
$X^{10}$ can be W;
$X^{11}$ can be selected from C, A, I, L, P, and V;
$X^{12}$ can be selected from C, D, G, H; and
$X^{13}$ can be selected from C, D, E, H, S, and T.

In Rγc ligands of Formula (13)-(13b), $X^1$ can be selected from D and E.

In Rγc ligands of Formula (13)-(13b), $X^2$ can be selected from L, M, R, S, V, and W.

In Rγc ligands of Formula (13)-(13b), $X^3$ can be selected from D and F.

In Rγc ligands of Formula (13)-(13b), $X^4$ can be S.

In Rγc ligands of Formula (13)-(13b), $X^5$ can be selected from D and E.

In Rγc ligands of Formula (13)-(13b), $X^6$ can be selected from D and E.

In Rγc ligands of Formula (13)-(13b), $X^7$ can be selected from L, M, and W.

In Rγc ligands of Formula (13)-(13b), $X^8$ can be G.

In Rγc ligands of Formula (13)-(13b), $X^9$ can be E.

In Rγc ligands of Formula (13)-(13b), $X^{10}$ can be W.

In Rγc ligands of Formula (13)-(13b), $X^{11}$ can be selected from I, L, and V.

In Rγc ligands of Formula (13)-(13b), $X^{12}$ can be selected from D and G.

In Rγc ligands of Formula (13)-(13b), $X^{13}$ can be selected from S and T.

In Rγc ligands of Formula (13)-(13b), the Rγc ligand can be defined by any combination of $X^1$-$X^{13}$ as defined in the immediately preceding thirteen (13) paragraphs.

In Rγc ligands of Formula (13)-(13b),
$X^1$ can be selected from D and E;
$X^2$ can be selected from L, M, R, S, V, and W;
$X^3$ can be selected from D and F;
$X^4$ can be S;

X⁵ can be selected from D and E;
X⁶ can be selected from D and E;
X⁷ can be selected from L, M, and W;
X⁸ can be G;
X⁹ can be E;
X¹⁰ can be W;
X¹¹ can be selected from I, L, and V;
X¹² can be selected from D and G; and
X¹³ can be selected from S and T.

An Rγc ligand can comprise an amino acid sequence selected from any one of SEQ ID NOS: 1065-1074:

```
                              SEQ ID NO: 1065
C E S F S E A L G T W I D C

SEQ ID NO: 1066
C V F L E D W W I W A G D C

SEQ ID NO: 1067
D C P Q V S W Y E W L D C Y

SEQ ID NO: 1068
E C D A F G W I I W P H C L

SEQ ID NO: 1069
F C W D S D K M L R W V C S

SEQ ID NO: 1070
L C F S E F L G E W V D C N

SEQ ID NO: 1071
M C W L E W G E W V G S C L

SEQ ID NO: 1072
Q C R R S D F E Y V W L C T

SEQ ID NO: 1073
V C S F D E A W G E W I C E

SEQ ID NO: 1074
Y C L F D E Q M G E W L C H
```

An Rγc ligand provided by the present disclosure can comprise a truncated amino acid sequence of any one of SEQ ID NOS: 1062-1074.

An Rγc ligand provided by the present disclosure can comprise an amino acid sequence selected from any one of SEQ ID NOS: 1062-1074, or a truncated amino acid sequence of any one of SEQ ID NOS: 1062-1074, wherein the amino acid sequence can independently comprise from 1 to 4 glycines (G) (SEQ ID NO: 9615) on the N-terminus, on the C-terminus, or on both the N- and C-termini.

An Rγc ligand provided by the present disclosure can comprise an amino acid sequence selected from any one of SEQ ID NOS: 1062-1074, or a truncated amino acid sequence of any one of SEQ ID NOS: 1062-1074, wherein the amino acid sequence comprises one or more amino acid substitutions such as from 1 to 5 amino acid substitutions. The amino acid substitutions can comprise conservative amino acid substitutions.

An Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 1062-1074 or to a truncated amino acid sequence of any one of SEQ ID NOS: 1062-1074.

An Rγc ligand of any one of SEQ ID NOS: 1062-1074, a truncated Rγc ligand of any one of SEQ ID NOS: 1062-1074, or a substituted Rγc ligand of any one of SEQ ID NOS: 1062-1074 can bind to the hRγc subunit with an IC$_{50}$ of less than 100 μM or less than 10 μM as determined using phage ELISA competition assays.

An Rγc ligand of any one of SEQ ID NOS: 1065-1072 binds to the hRγc subunit with an IC$_{50}$ of less than 100 μM.

An Rγc ligand can comprise an amino acid sequence of Formula (13) (SEQ ID NO: 1062), an amino acid sequence of Formula (13a) (SEQ ID NO: 1063), or an amino acid sequence of Formula (13b) (SEQ ID NO: 1064):

$$-X^3-X^4-X^5-X^6-X^7-X^8-X^9-X^{10}-X^{11}- \quad (13)$$

$$-X^2-X^3-X^4-X^5-X^6-X^7-X^8-X^9-X^{10}-X^{11}-X^{12}- \quad (13a)$$

$$-X^1-X^2-X^3-X^4-X^5-X^6-X^7-X^8-X^9-X^{10}-X^{11}-X^{12}-X^{13}- \quad (13b)$$

wherein,
X¹ can be selected from an amino acid comprising an acidic side chain or cysteine;
X² can be selected from an amino acid;
X³ can be selected from an amino acid comprising an acidic side chain or large hydrophobic side chain;
X⁴ can be selected from an amino acid;
X⁵ can be selected from an amino acid;
X⁶ can be selected from an amino acid;
X⁷ can be selected from an amino acid comprising a large hydrophobic side chain;
X⁸ can be selected from an amino acid comprising a small hydrophobic side chain or a large hydrophobic side chain;
X⁹ can be selected from an amino acid;
X¹⁰ can be selected from an amino acid comprising a large hydrophobic side chain;
X¹¹ can be selected from an amino acid comprising a large hydrophobic side chain;
X¹² can be selected from an amino acid comprising a small hydrophobic side chain or an acidic side chain or cysteine; and
X¹³ can be selected from an amino acid comprising an acidic side chain or a hydroxyl-containing side chain or cysteine.

In Rγc ligands of Formula (13)-(13b),
X¹ can be selected from an amino acid comprising an acidic side chain;
X² can be selected from an amino acid;
X³ can be selected from an amino acid comprising an acidic side chain or large hydrophobic side chain;
X⁴ can be selected from an amino acid comprising an acidic side chain or a hydroxyl-containing side chain;
X⁵ can be selected from an amino acid comprising an acidic side chain;
X⁶ can be selected from an amino acid;
X⁷ can be selected from an amino acid comprising a large hydrophobic side chain;
X⁸ can be selected from an amino acid comprising a small hydrophobic side chain or a large hydrophobic side chain;
X⁹ can be selected from an amino acid comprising an acidic side chain or large hydrophobic side chain;
X¹⁰ can be selected from an amino acid comprising a large hydrophobic side chain;
X¹¹ can be selected from an amino acid comprising a large hydrophobic side chain;
X¹² can be selected from an amino acid comprising a small hydrophobic side chain or an acidic side chain; and
X¹³ can be selected from an amino acid comprising an acidic side chain or a hydroxyl-containing side chain.

In Rγc ligands of Formula (13)-(13b),
X¹ can be selected from D and E;
X² can be selected from an amino acid;

$X^3$ can be selected from D, E, F, I, L, M, V, Y, and W;
$X^4$ can be selected from D, E, S, and T;
$X^5$ can be selected from D and E;
$X^6$ can be selected from an amino acid;
$X^7$ can be selected from F, I, L, M, V, Y, and W;
$X^8$ can be selected from A, G, P, S, T, F, I, L, M, V, Y, and W;
$X^9$ can be selected from D, E, F, I, L, M, V, Y, and W;
$X^{10}$ can be selected from F, I, L, M, V, Y, and W;
$X^{11}$ can be selected from F, I, L, M, V, Y, and W;
$X^{11}$ can be selected from D, E, A, G, P, S, and T; and
$X^1$ can be selected from D, E, S, and T.

In Rγc ligands of Formula (13)-(13b), $X^1$ can be selected from D and E.
In Rγc ligands of Formula (13)-(13b), $X^2$ can be selected from an amino acid.
In Rγc ligands of Formula (13)-(13b), $X^3$ can be selected from D and F.
In Rγc ligands of Formula (13)-(13b), $X^4$ can be S.
In Rγc ligands of Formula (13)-(13b), $X^5$ can be selected from D and E.
In Rγc ligands of Formula (13)-(13b), $X^6$ can be selected from an amino acid.
In Rγc ligands of Formula (13)-(13b), $X^7$ can be selected from L, M, and W.
In Rγc ligands of Formula (13)-(13b), $X^8$ can be G.
In Rγc ligands of Formula (13)-(13b), $X^9$ can be E.
In Rγc ligands of Formula (13)-(13b), $X^{10}$ can be W.
In Rγc ligands of Formula (13)-(13b), $X^{11}$ can be selected from I, L, and V.
In Rγc ligands of Formula (13)-(13b), $X^{12}$ can be selected from D and G.
In Rγc ligands of Formula (13)-(13b), $X^{13}$ can be selected from S and T.

In Rγc ligands of Formula (13)-(13b), the Rγc ligand can be defined by any combination of $X^1$-$X^{13}$ as defined in the immediately preceding thirteen (13) paragraphs.

In Rγc ligands of Formula (13)-(13b),
$X^1$ can be selected from D and E;
$X^2$ can be selected from an amino acid;
$X^3$ can be selected from D and F;
$X^4$ can be S;
$X^5$ can be selected from D and E;
$X^6$ can be selected from an amino acid;
$X^7$ can be selected from L, M, and W;
$X^8$ can be G;
$X^9$ can be E;
$X^{10}$ can be W;
$X^{11}$ can be selected from I, L, and V;
$X^{12}$ can be selected from D and G; and
$X^{13}$ can be selected from S and T.

An Rγc ligand can comprise an amino acid sequence of Formula (14) (SEQ ID NO: 1075), an amino acid sequence of Formula (14a) (SEQ ID NO: 1076), an amino acid sequence of Formula (14b) (SEQ ID NO: 1077), or an amino acid sequence of Formula (14c) (SEQ ID NO: 1078):

-$X^4$-$X^5$-C-$X^6$-$X^7$-$X^8$- (14)

-$X^3$-$X^4$-$X^5$-C-$X^6$-$X^7$-$X^8$-$X^9$- (14a)

-$X^2$-$X^3$-$X^4$-$X^5$-C-$X^6$-$X^7$-$X^8$-$X^9$-$X^{10}$- (14b)

-$X^1$-$X^2$-$X^3$-$X^4$-$X^5$-C-$X^6$-$X^7$-$X^8$-$X^9$-$X^{10}$-$X^{11}$- (14c)

wherein,
$X^1$ can be selected from D, G, I, and Q;
$X^2$ can be selected from D, I, and L;
$X^3$ can be selected from G, L, M, Q, R, S, and Y;
$X^4$ can be selected from D, E, G, L, S, T, and Y;
$X^5$ can be selected from E, L, P, and Q;
$X^6$ can be selected from D, E, K, L, S, and T;
$X^7$ can be selected from D, F, S, and W;
$X^8$ can be selected from F, N, W, and Y;
$X^9$ can be selected from F, I, L, R, and W;
$X^{10}$ can be selected from A, E, L, and S; and
$X^{11}$ can be selected from H, I, K, N, Q, and V.

In Rγc ligands of Formula (14)-(14c), $X^1$ can be selected from D and Q.
In Rγc ligands of Formula (14)-(14c), $X^2$ can be selected from I and L.
In Rγc ligands of Formula (14)-(14c), $X^3$ can be selected from G, L, M, R, S, and Y.
In Rγc ligands of Formula (14)-(14c), $X^4$ can be L.
In Rγc ligands of Formula (14)-(14c), $X^5$ can be selected from E and Q.
In Rγc ligands of Formula (14)-(14c), $X^6$ can be selected from D and E.
In Rγc ligands of Formula (14)-(14c), $X^7$ can be selected from F and W.
In Rγc ligands of Formula (14)-(14c), $X^8$ can be selected from F, W, and Y.
In Rγc ligands of Formula (14)-(14c), $X^9$ can be selected from F, I, and L.
In Rγc ligands of Formula (14)-(14c), $X^{10}$ can be S.
In Rγc ligands of Formula (14)-(14c), $X^{11}$ can be selected from N and Q.

In Rγc ligands of Formula (14)-(14c), the Rγc ligand can be defined by any combination of $X^1$-$X^{11}$ as defined in the immediately preceding eleven (11) paragraphs.

In Rγc ligands of Formula (14)-(14c),
$X^1$ can be selected from D and Q;
$X^2$ can be selected from I and L;
$X^3$ can be selected from G, L, M, R, S, and Y;
$X^4$ can be L;
$X^5$ can be selected from E and Q;
$X^6$ can be selected from D and E;
$X^7$ can be selected from F and W;
$X^8$ can be selected from F, W, and Y;
$X^9$ can be selected from F, I, and L;
$X^{10}$ can be S; and
$X^{11}$ can be selected from N and Q.

In Rγc ligands of Formula (14)-(14c),
$X^1$ can be selected from D, G, I, Q, and W;
$X^2$ can be selected from C, D, I, and L;
$X^3$ can be selected from G, L, M, Q, R, S, and Y;
$X^4$ can be selected from D, E, G, L, Q, S, T, and Y;
$X^5$ can be selected from E, G, L, P, and Q;
$X^6$ can be selected from D, E, K, L, S, and T;
$X^7$ can be selected from D, F, S, and W;
$X^8$ can be selected from F, N, W, and Y;
$X^9$ can be selected from F, I, L, R, and W;
$X^{10}$ can be selected from A, C, E, L, and S; and
$X^{11}$ can be selected from H, I, K, N, Q, and V.

In Rγc ligands of Formula (14)-(14c),
$X^1$ can be selected from D and Q;
$X^2$ can be selected from I and L;
$X^3$ can be selected from G, L, M, Q, R, S, and Y;
$X^4$ can be selected from D and S;
$X^5$ can be L;
$X^6$ can be selected from D and E;
$X^7$ can be selected from F and W;
$X^8$ can be selected from F, W, and Y;
$X^9$ can be selected from F, I, L, and W;
$X^{10}$ can be selected from L and S; and
$X^{11}$ can be selected from N and Q.

An Rγc ligand can comprise an amino acid sequence selected from any one of SEQ ID NOS: 1079-1087:

```
                      SEQ ID NO: 1079
D L S D L C T F W L S Q

SEQ ID NO: 1080
G L Q E L C S F Y I A Q

SEQ ID NO: 1081
I D M Y P Q E W W F C N

SEQ ID NO: 1082
L S L G Q K D W W L I L

SEQ ID NO: 1083
Q I R Q L C E F W L S Q

SEQ ID NO: 1084
Q L G T L C D F F R E N

SEQ ID NO: 1085
Q L Q G L C D F F W A H

SEQ ID NO: 1086
W C L S Q E E F N F L V

SEQ ID NO: 1087
Y S E E L S W I C K Q L
```

An Rγc ligand provided by the present disclosure can comprise a truncated amino acid sequence of any one of SEQ ID NOS: 1075-1087.

An Rγc ligand provided by the present disclosure can comprise an amino acid sequence selected from any one of SEQ ID NOS: 1075-1087, or a truncated amino acid sequence of any one of SEQ ID NOS: 1075-1087, wherein the amino acid sequence can independently comprise from 1 to 4 glycines (G) (SEQ ID NO: 9615) on the N-terminus, on the C-terminus, or on both the N- and C-termini.

An Rγc ligand provided by the present disclosure can comprise an amino acid sequence selected from any one of SEQ ID NOS: 1075-1087, or a truncated amino acid sequence of any one of SEQ ID NOS: 1075-1087, wherein the amino acid sequence comprises one or more amino acid substitutions such as from 1 to 5 amino acid substitutions. The amino acid substitutions can comprise conservative amino acid substitutions.

An Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 1075-1087 or to a truncated amino acid sequence of any one of SEQ ID NOS: 1075-1087.

An Rγc ligand of any one of SEQ ID NOS: 1075-1087, a truncated Rγc ligand of any one of SEQ ID NOS: 1075-1087, or a substituted Rγc ligand of any one of SEQ ID NOS: 1075-1087 can bind to the hRγc subunit with an $IC_{50}$ of less than 100 μM or less than 10 μM as determined using phage ELISA competition assays.

An Rγc ligand of any one of SEQ ID NOS: 1079-1087 binds to the hRγc subunit with an $IC_{50}$ of less than 100 μM.

An Rγc ligand can comprise an amino acid sequence of Formula (14) (SEQ ID NO: 1075), an amino acid sequence of Formula (14a) (SEQ ID NO: 1076), an amino acid sequence of Formula (14b) (SEQ ID NO: 1077), or an amino acid sequence of Formula (14c) (SEQ ID NO: 1078):

$$-X^4-X^5-C-X^6-X^7-X- \quad (14)$$

$$-X^3-X^4-X^5-C-X^6-X^7-X^8-X^9- \quad (14a)$$

$$-X^2-X^3-X^4-X^5-C-X^6-X^7-X^8-X^9-X^{10}- \quad (14b)$$

$$-X^1-X^2-X^3-X^4-X^5-C-X^6-X^7-X^8-X^9-X^{10}-X^{11}- \quad (14c)$$

wherein, $X^1$ can be selected from an amino acid;

$X^2$ can be selected from an amino acid comprising a large hydrophobic side chain or an acidic side chain;

$X^3$ can be selected from an amino acid;

$X^4$ can be selected from an amino acid comprising an acidic side chain or a hydroxyl-containing side chain;

$X^5$ can be selected from an amino acid;

$X^6$ can be selected from an amino acid;

$X^7$ can be selected from an amino acid comprising a large hydrophobic side chain;

$X^8$ can be selected from an amino acid comprising a large hydrophobic side chain;

$X^9$ can be selected from an amino acid comprising a large hydrophobic side chain;

$X^{10}$ can be selected from an amino acid; and $X^{11}$ can be selected from an amino acid.

In Rγc ligands of Formula (14)-(14c), $X^1$ can be selected from an amino acid;

$X^2$ can be selected from an amino acid comprising a large hydrophobic side chain or an acidic side chain;

$X^3$ can be selected from an amino acid;

$X^4$ can be selected from an amino acid comprising an acidic side chain or a hydroxyl-containing side chain;

$X^5$ can be selected from an amino acid comprising a large hydrophobic side chain;

$X^6$ can be selected from an amino acid comprising an acidic side chain;

$X^7$ can be selected from an amino acid comprising a large hydrophobic side chain;

$X^8$ can be selected from an amino acid comprising a large hydrophobic side chain;

$X^9$ can be selected from an amino acid comprising a large hydrophobic side chain;

$X^{10}$ can be selected from an amino acid; and $X^{11}$ can be selected from an amino acid comprising a polar-neutral side chain.

In Rγc ligands of Formula (14)-(14c), $X^1$ can be selected from an amino acid;

$X^2$ can be selected from D, E, F, I, L, M, V, Y, and W;

$X^3$ can be selected from an amino acid;

$X^4$ can be selected from D, E, S, and T;

$X^5$ can be selected from F, I, L, M, V, Y, and W;

$X^6$ can be selected from D and E;

$X^7$ can be selected from F, I, L, M, V, Y, and W;

$X^8$ can be selected from F, I, L, M, V, Y, and W;

$X^9$ can be selected from F, I, L, M, V, Y, and W;

$X^{10}$ can be selected from an amino acid; and $X^{11}$ can be selected from H, N, Q, S, T, and Y.

In Rγc ligands of Formula (14)-(14c), $X^1$ can be selected from an amino acid.

In Rγc ligands of Formula (14)-(14c), $X^2$ can be selected from I and L.

In Rγc ligands of Formula (14)-(14c), $X^3$ can be selected from an amino acid.

In Rγc ligands of Formula (14)-(14c), $X^4$ can be selected from D, E, and S.

In Rγc ligands of Formula (14)-(14c), $X^5$ can be L.

In Rγc ligands of Formula (14)-(14c), $X^6$ can be selected from D and E.

In Rγc ligands of Formula (14)-(14c), $X^7$ can be selected from F and W.

In Rγc ligands of Formula (14)-(14c), X⁸ can be selected from F, W and Y.

In Rγc ligands of Formula (14)-(14c), X⁹ can be selected from F, I, and L.

In Rγc ligands of Formula (14)-(14c), X¹⁰ can be selected from an amino acid.

In Rγc ligands of Formula (14)-(14c), X¹¹ can be selected from Q and N.

In Rγc ligands of Formula (14)-(14c), the Rγc ligand can be defined by any combination of X¹-X¹¹ as defined in the immediately preceding twelve (12) paragraphs.

In Rγc ligands of Formula (14)-(14c),
X¹ can be selected from an amino acid;
X² can be selected from I and L;
X³ can be selected from an amino acid;
X⁴ can be selected from D, E, and S;
X⁵ can be L;
X⁶ can be selected from D and E;
X⁷ can be selected from F and W;
X⁸ can be selected from F, W and Y;
X⁹ can be selected from F, I, and L;
X¹⁰ can be selected from an amino acid; and
X¹¹ can be selected from Q and N.

An Rγc ligand can comprise an amino acid sequence selected from any one of SEQ ID NOS: 1088-1105:

```
                                         SEQ ID NO: 1088
C P L S L M G S E R I F V C

SEQ ID NO: 1089
C T Y F G P D A F R M L F C

SEQ ID NO: 1090
C Y F N S I F L G E S P F C

SEQ ID NO: 1091
C Y L I Y K N N Q L A L Q C

SEQ ID NO: 1092
C Y V V Y N Y Q E F R Y L C

SEQ ID NO: 1093
C D C Q H H R C R T G G L V

SEQ ID NO: 1094
C D L W P L T A Q N F Y G C

SEQ ID NO: 1095
C P G E L R G P E R A W V C

SEQ ID NO: 1096
E C G G A W A M L L W P H C T

SEQ ID NO: 1097
I C T R L H D V V P I W S C P

SEQ ID NO: 1098
L Y C R D N D G T Q Y C E T

SEQ ID NO: 1099
L E C A T S E E P Y Y C Y L

SEQ ID NO: 1100
L F N F C Q G D K T C M Q W H

SEQ ID NO: 1101
L F N F C Q G D K T C M Q W H

SEQ ID NO: 1102
Q C Y R P S R D I P L Y L C S

SEQ ID NO: 1103
V C W L T H N R Q S Y Y C D

SEQ ID NO: 1104
Y Y C Y L N I W T M K C E D

SEQ ID NO: 1105
Y Y C Y L N I W P V K C E D
```

An Rγc ligand provided by the present disclosure can comprise a truncated amino acid sequence of any one of SEQ ID NOS: 1075-1078 and 1088-1105.

An Rγc ligand provided by the present disclosure can comprise an amino acid sequence selected from any one of SEQ ID NOS: 1075-1078 and 1088-1105, or a truncated amino acid sequence of any one of SEQ ID NOS: 1075-1078 and 1088-1105, wherein the amino acid sequence can independently comprise from 1 to 4 glycines (G) (SEQ ID NO: 9615) on the N-terminus, on the C-terminus, or on both the N- and C-termini.

An Rγc ligand provided by the present disclosure can comprise an amino acid sequence selected from any one of SEQ ID NOS: 1075-1078 and 1088-1105, or to a truncated amino acid sequence of any one of SEQ ID NOS: 1075-1078 and 1088-1105, wherein the amino acid sequence comprises one or more amino acid substitutions such as from 1 to 5 amino acid substitutions. The amino acid substitutions can comprise conservative amino acid substitutions.

An Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 1075-1078 and 1088-1105 or a truncated amino acid sequence of any one of SEQ ID NOS: 1075-1078 and 1088-1105.

An Rγc ligand of any one of SEQ ID NOS: 1075-1078 and 1088-1105, a truncated Rγc ligand of any one of SEQ ID NOS: 1075-1078 and 1088-1105, or a substituted Rγc ligand of any one of SEQ ID NOS: 1075-1078 and 1088-1105 can bind to the hRγc subunit with an IC$_{50}$ of less than 100 μM or less than 10 μM as determined using phage ELISA competition assays.

An Rγc ligand of any one of SEQ ID NOS: 1088-1105 binds to the hRγc subunit with an IC$_{50}$ of less than 100 μM.

An Rγc ligand can comprise an amino acid sequence of Formula (15) (SEQ ID NO: 1106) or an amino acid sequence of Formula (15a) (SEQ ID NO: 1107):

$$-C-X^1-X^2-X^3-X^4-X^5-X^6-X^7-X^8-X^9-X^{10}-X^{11}-X^{12}-C- \quad (15)$$

$$-X^1-X^2-X^3-X^4-X^5-X^6-X^7-X^8-X^9-X^{10}-X^{11}-X^{12}- \quad (15a)$$

wherein,
X¹ can be selected from an amino acid comprising a large hydrophobic side chain;
X² can be selected from an amino acid comprising a large hydrophobic side chain;
X³ can be selected from an amino acid comprising a large hydrophobic side chain;
X⁴ can be selected from an amino acid comprising a large hydrophobic side chain or an aromatic side chain;
X⁵ can be selected from an amino acid comprising a basic side chain and an acidic or polar neutral side chain;
X⁶ can be selected from an amino acid;
X⁷ can be selected from an amino acid comprising a small hydrophobic side chain;
X⁸ can be selected from an amino acid comprising an acidic or a polar neutral side chain;
X⁹ can be selected from an amino acid comprising a large hydrophobic side chain or an aromatic side chain;

$X^{10}$ can be selected from an amino acid comprising a small hydrophobic side chain or a hydroxyl-containing side chain;

$X^{11}$ can be selected from an amino acid comprising a large hydrophobic side chain or an aromatic side chain; and $X^{12}$ can be selected from an amino acid comprising a large hydrophobic side chain.

In Rγc ligands of Formula (15)-(15a),
$X^1$ can be selected from F, I, L, M, V, Y, and W;
$X^2$ can be selected from F, I, L, M, V, Y, and W;
$X^3$ can be selected from F, I, L, M, V, Y, and W;
$X^4$ can be selected from F, H, I, L, M, V, Y, and W;
$X^5$ can be selected from R, K, H, D, E, N, and Q;
$X^6$ can be selected from an amino acid;
$X^7$ can be selected from A, G, P, S, and T;
$X^8$ can be selected from D, E, N, and Q;
$X^9$ can be selected from F, H, I, L, M, V, Y, and W;
$X^{10}$ can be selected from A, G, P, S, T, and Y;
$X^{11}$ can be selected from F, H, I, L, M, V, Y, and W; and
$X^1$ can be selected from F, I, L, M, V, Y, and W.

In Rγc ligands of Formula (15)-(15a),
$X^1$ can be selected from F and Y;
$X^2$ can be I;
$X^3$ can be selected from F, I, L, M, V, Y, and W;
$X^4$ can be Y;
$X^5$ can be R;
$X^6$ can be selected from an amino acid;
$X^7$ can be G;
$X^8$ can be E;
$X^9$ can be F;
$X^{10}$ can be selected from S, T, and Y;
$X^{11}$ can be Y; and
$X^{12}$ can be selected from F, I, L, M, V, Y, and W.

In Rγc ligands of Formula (15)-(15a), $X^1$ can be selected from F and Y.

In Rγc ligands of Formula (15)-(15a), $X^2$ can be selected from I, V, and L.

In Rγc ligands of Formula (15)-(15a), $X^2$ can be I.

In Rγc ligands of Formula (15)-(15a), $X^3$ can be selected from M, L, Y, and I.

In Rγc ligands of Formula (15)-(15a), $X^4$ can be selected from F, H, and Y.

In Rγc ligands of Formula (15)-(15a), $X^4$ can be Y.

In Rγc ligands of Formula (15)-(15a), $X^5$ can be selected from R, K, D, and E.

In Rγc ligands of Formula (15)-(15a), $X^5$ can be R.

In Rγc ligands of Formula (15)-(15a), $X^6$ can be selected from an amino acid.

In Rγc ligands of Formula (15)-(15a), $X^7$ can be G.

In Rγc ligands of Formula (15)-(15a), $X^8$ can be selected from D and E.

In Rγc ligands of Formula (15)-(15a), $X^8$ can be E.

In Rγc ligands of Formula (15)-(15a), $X^9$ can be selected from F, Y, and W.

In Rγc ligands of Formula (15)-(15a), $X^9$ can be F.

In Rγc ligands of Formula (15)-(15a), $X^{10}$ can be selected from S and T.

In Rγc ligands of Formula (15)-(15a), $X^{11}$ can be selected from F, I, L, M, V, Y, and W.

In Rγc ligands of Formula (15)-(15a), $X^{11}$ can be Y.

In Rγc ligands of Formula (15)-(15a), $X^{12}$ can be selected from I, L, M, V, and Y.

In Rγc ligands of Formula (15)-(15a), the Rγc ligand can be defined by any combination of $X^1$-$X^{12}$ as defined in the immediately preceding eighteen (18) paragraphs.

In Rγc ligands of Formula (15)-(15a),
$X^1$ can be selected from F and Y;
$X^2$ can be I;
$X^3$ can be selected from M, L, Y, and I;
$X^4$ can be Y;
$X^5$ can be R;
$X^6$ can be selected from an amino acid;
$X^7$ can be G;
$X^8$ can be E;
$X^9$ can be F;
$X^{10}$ can be selected from S and T;
$X^{11}$ can be Y; and
$X^{12}$ can be selected from F, I, L, M, V, Y, and W.

In Rγc ligands of Formula (15)-(15a),
$X^1$ can be selected A, C, D, E, F, G, L, P, and Y;
$X^2$ can be selected from C, I, L, N, S, and V;
$X^3$ can be selected from A, I, L, M, Q, R, and Y;
$X^4$ can be selected from F, H, K, L, T, and Y;
$X^5$ can be selected from D, E, G, H, I, K, L, P, Q, R, S, and Y;
$X^6$ can be selected from E, F, G, H, I, L, N, Q, R, S, and T;
$X^7$ can be selected from C, D, E, G, K, N, P, Q, and T;
$X^8$ can be selected from D, E, F, K, P, R, and T;
$X^9$ can be selected from A, F, L, R, T, V, W, and Y;
$X^{10}$ can be selected from D, E, G, L, N, S, T, W, and Y;
$X^{11}$ can be selected from A, C, F, G, I, L, M, and Y; and
$X^{12}$ can be selected from C, E, I, L, M, V, and Y.

In Rγc ligands of Formula (15)-(15a),
$X^1$ can be selected F and Y;
$X^2$ can be selected from I, L, and V;
$X^3$ can be selected from I, M, R, and Y;
$X^4$ can be selected from F, H, and Y;
$X^5$ can be selected from D, E, K, and R;
$X^6$ can be selected from E, F, G, H, I, L, N, Q, R, S, and T;
$X^7$ can be G;
$X^8$ can be selected from D and E;
$X^9$ can be selected from F, W, and Y;
$X^{10}$ can be selected from S and T;
$X^{11}$ can be selected from F, I, L, M, and Y; and
$X^{12}$ can be selected from I, L, M, V and Y.

In Rγc ligands of Formula (15)-(15a),
$X^1$ can be F;
$X^2$ can be I;
$X^3$ can be selected from I, M, R, and Y;
$X^4$ can be Y;
$X^5$ can be selected from D, E, K, and R;
$X^6$ can be selected from E, F, G, H, I, L, N, Q, R, S, and T;
$X^7$ can be G;
$X^8$ can be E;
$X^9$ can be F;
$X^{10}$ can be selected from S and T;
$X^{11}$ can be Y; and
$X^{12}$ can be selected from I, L, M, V and Y.

In Rγc ligands of Formula (15)-(15a),
$X^1$ can be F;
$X^2$ can be I;
$X^4$ can be Y;
$X^5$ can be R;
$X^6$ can be selected from E, F, G, H, I, L, N, Q, R, S, and T;
$X^7$ can be G;
$X^8$ can be E;
$X^9$ can be F; and
$X^{11}$ can be Y.

An Rγc ligand can comprise an amino acid sequence selected from any one of SEQ ID NOS: 1108-1119:

C G I A Y R S G E F T M I C    SEQ ID NO: 1108

C P S M L Q G P E R T W V C    SEQ ID NO: 1109

C A N L H D T Q E W W Y Y C    SEQ ID NO: 1110

C E L L T G I P E Y N F L C    SEQ ID NO: 1111

C F I R F Y Q D K Y D Y V C    SEQ ID NO: 1112

C F I R Y L R G E F S F V C    SEQ ID NO: 1113

C F L R F I H G E L D Y Y C    SEQ ID NO: 1114

C F V M Y K N N E F S L I C    SEQ ID NO: 1115

C G I A Y R S G E F T M I C    SEQ ID NO: 1116

C L I Y K E Q K F A L I E C    SEQ ID NO: 1117

C Y I I Y R L G T F S Y M C    SEQ ID NO: 1118

W C I Y Y P F T D V E A C T    SEQ ID NO: 1119

An Rγc ligand provided by the present disclosure can comprise a truncated amino acid sequence of any one of SEQ ID NOS: 1106-1119.

An Rγc ligand provided by the present disclosure can comprise an amino acid sequence selected from any one of SEQ ID NOS: 1106-1119, or a truncated amino acid sequence of any one of SEQ ID NOS: 1106-1119, wherein the amino acid sequence can independently comprise from 1 to 4 glycines (G) (SEQ ID NO: 9615) on the N-terminus, on the C-terminus, or on both the N- and C-termini.

An Rγc ligand provided by the present disclosure can comprise an amino acid sequence selected from any one of SEQ ID NOS: 1106-1119, or a truncated amino acid sequence of any one of SEQ ID NOS: 1106-1119, wherein the amino acid sequence comprises one or more amino acid substitutions such as from 1 to 5 amino acid substitutions. The amino acid substitutions can comprise conservative amino acid substitutions.

An Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 1106-1119 or to a truncated amino acid sequence of any one of SEQ ID NOS: 1106-1119.

An Rγc ligand of any one of SEQ ID NOS: 1106-1119, a truncated Rγc ligand of any one of SEQ ID NOS: 1106-1119, or a substituted Rγc ligand of any one of SEQ ID NOS: 1106-1119 can bind to the hRγc subunit with an $IC_{50}$ of less than 100 μM or less than 10 μM as determined using phage ELISA competition assays.

An Rγc ligand of any one of SEQ ID NOS: 1108-1119 binds to the hRγc subunit with an $IC_{50}$ of less than 100 μM.

An Rγc ligand can comprise an amino acid sequence of Formula (16) (SEQ ID NO: 1120), an amino acid sequence of Formula (16a) (SEQ ID NO: 1121), an amino acid sequence of Formula (16b) (SEQ ID NO: 1122), an amino acid sequence of Formula (16c) (SEQ ID NO: 1123), or the amino acid sequence of Formula (16d) (SEQ ID NO: 1124):

$$-X^5-X^6-X^7-X^8-X^9- \quad (16)$$

$$-C-X^5-X^6-X^7-X^8-X^9-C- \quad (16a)$$

$$-X^4-C-X^5-X^6-X^7-X^8-X^9-C-X^{10}- \quad (16b)$$

$$-X^3-X^4-C-X^5-X^6-X^7-X^8-X^9-C-X^{10}-X^{11}- \quad (16c)$$

$$-X^1-X^2-X^3-X^4-C-X^5-X^6-X^7-X^8-X^9-C-X^{10}-X^{11}-X^{12}-X^{13}- \quad (16d)$$

wherein, $X^1$ can be selected from an amino acid comprising a small hydrophobic side chain or a hydroxyl-containing side chain;

$X^2$ can be selected from an amino acid comprising a large hydrophobic side chain;

$X^3$ can be selected from an amino acid comprising an acidic or polar neutral side chain;

$X^4$ can be selected from an amino acid comprising a basic side chain;

$X^5$ can be selected from an amino acid comprising a large hydrophobic side chain;

$X^6$ can be selected from an amino acid comprising a small hydrophobic side chain or a hydroxyl-containing side chain;

$X^7$ can be selected from an amino acid comprising a small hydrophobic side chain;

$X^8$ can be selected from an amino acid comprising a small hydrophobic side chain or a hydroxyl-containing side chain;

$X^9$ can be selected from an amino acid comprising a small hydrophobic side chain or a hydroxyl-containing side chain;

$X^{10}$ can be selected from an amino acid comprising a small hydrophobic side chain or a hydroxyl-containing side chain;

$X^{11}$ can be selected from an amino acid;

$X^{12}$ can be selected from an amino acid comprising a large hydrophobic side chain or a basic side chain; and $X^{13}$ can be selected from an amino acid comprising a large hydrophobic side chain.

In Rγc ligands of Formula (16)-(16d), $X^1$ can be selected from A, G, P, S, and T;

$X^2$ can be selected from F, I, L, M, V, Y, and W;

$X^3$ can be selected from D, E, N, and Q;

$X^4$ can be selected from H, K, and R;

$X^5$ can be selected from F, I, L, M, V, Y, and W;

$X^6$ can be selected from A, G, P, S, and T;

$X^7$ can be selected from A, G, P, S, and T;

$X^8$ can be selected from A, G, P, S, and T;

$X^9$ can be selected from A, G, P, S, and T;

$X^{10}$ can be selected from A, G, P, S, and T;

$X^{11}$ can be selected from an amino acid;

$X^{12}$ can be selected from F, I, L, M, V, Y, W, R, K, and H; and $X^{13}$ can be selected from F, I, L, M, V, Y, and W.

In Rγc ligands of Formula (16)-(16d), $X^1$ can be selected from K, M, N, and K;

$X^2$ can be selected from M, L, and Y;

$X^3$ can be selected from N, Y, and L;

$X^4$ can be K;

$X^5$ can be selected from A, W, R, Y, and N;
$X^6$ can be selected from T, N, and S;
$X^7$ can be selected from P and A;
$X^8$ can be selected from S, R, F, and L;
$X^9$ can be selected from Q, S, E, and T;
$X^{10}$ can be selected from S, Q, and A;
$X^{11}$ can be selected from V, S, G, L, and N;
$X^{12}$ can be selected from I, K, R, and V; and
$X^{13}$ can be selected from F and L.

In Rγc ligands of Formula (16)-(16d), $X^1$ can be selected from S and T.

In Rγc ligands of Formula (16)-(16d), $X^2$ can be selected from L and M.

In Rγc ligands of Formula (16)-(16d), $X^2$ can be L.

In Rγc ligands of Formula (16)-(16d), $X^3$ can be N.

In Rγc ligands of Formula (16)-(16d), $X^4$ can be K.

In Rγc ligands of Formula (16)-(16d), $X^5$ can be selected from W and Y.

In Rγc ligands of Formula (16)-(16d), $X^6$ can be selected from S and T.

In Rγc ligands of Formula (16)-(16d), $X^6$ can be S.

In Rγc ligands of Formula (16)-(16d), $X^7$ can be P.

In Rγc ligands of Formula (16)-(16d), $X^8$ can be S.

In Rγc ligands of Formula (16)-(16d), $X^9$ can be selected from S and T.

In Rγc ligands of Formula (16)-(16d), $X^9$ can be S.

In Rγc ligands of Formula (16)-(16d), $X^{10}$ can be S.

In Rγc ligands of Formula (16)-(16d), $X^{11}$ can be selected from an amino acid.

In Rγc ligands of Formula (16)-(16d), $X^{12}$ can be selected from I, V, R, and K.

In Rγc ligands of Formula (16)-(16d), $X^{12}$ can be selected from I and V.

In Rγc ligands of Formula (16)-(16d), $X^{12}$ can be selected from R and K.

In Rγc ligands of Formula (16)-(16d), $X^{13}$ can be selected from F and L.

In Rγc ligands of Formula (16)-(16d), $X^{13}$ can be L.

In Rγc ligands of Formula (16)-(16d), the Rγc ligand can be defined by any combination of $X^1$-$X^{13}$ as defined in the immediately preceding nineteen (19) paragraphs.

In Rγc ligands of Formula (16)-(16d),
$X^1$ can be selected from S and T;
$X^2$ can be L;
$X^3$ can be N;
$X^4$ can be K;
$X^5$ can be selected from W and Y;
$X^6$ can be S;
$X^7$ can be P;
$X^8$ can be S;
$X^9$ can be S;
$X^{10}$ can be S T;
$X^{11}$ can be selected from an amino acid;
$X^{12}$ can be I; and
$X^{13}$ can be F.

In Rγc ligands of Formula (16)-(16d),
$X^2$ can be L;
$X^3$ can be N;
$X^4$ can be K;
$X^6$ can be S;
$X^7$ can be P;
$X^8$ can be S;
$X^9$ can be S;
$X^{10}$ can be S;
$X^{11}$ can be I; and
$X^{12}$ can be F.

An Rγc ligand can comprise an amino acid sequence selected from any one of SEQ ID NOS: 1125-1130:

```
                              SEQ ID NO: 1125
K M N K C A T P S Q C S V I F

SEQ ID NO: 1126
N L N K C W N P R S C S S K F

SEQ ID NO: 1127
S L Y K C N S P L S C S N I F

SEQ ID NO: 1128
S L L K C Y N A S T C A S V F

SEQ ID NO: 1129
T Y N K C R S P F E C S G I F

SEQ ID NO: 1130
Y L N K C Y S P S S C Q L R L
```

An Rγc ligand provided by the present disclosure can comprise a truncated amino acid sequence of any one of SEQ ID NOS: 1120-1130.

An Rγc ligand provided by the present disclosure can comprise an amino acid sequence selected from any one of SEQ ID NOS: 1120-1130, or a truncated amino acid sequence of any one of SEQ ID NOS: 1120-1130, wherein the amino acid sequence can independently comprise from 1 to 4 glycines (G) (SEQ ID NO: 9615) on the N-terminus, on the C-terminus, or on both the N- and C-termini.

An Rγc ligand provided by the present disclosure can comprise an amino acid sequence selected from any one of SEQ ID NOS: 1120-1130, or a truncated amino acid sequence of any one of SEQ ID NOS: 1120-1130, wherein the amino acid sequence comprises one or more amino acid substitutions such as from 1 to 5 amino acid substitutions. The amino acid substitutions can comprise conservative amino acid substitutions.

An Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 1120-1130 or a truncated amino acid sequence of any one of SEQ ID NOS: 1120-1130.

An Rγc ligand of anyone of can bind to the hRγc subunit with an $IC_{50}$ of less than 10 μM as determined using phage ELISA competition assays.

An Rγc ligand of any one of SEQ ID NOS: 1120-1130, a truncated Rγc ligand of any one of SEQ ID NOS: 1120-1130, or a substituted Rγc ligand of any one of SEQ ID NOS: 1120-1130 can bind to the hRγc subunit with an $IC_{50}$ of less than 100 μM or less than 10 μM as determined using phage ELISA competition assays.

An Rγc ligand of any one of SEQ ID NOS: 1125-1130 binds to the hRγc subunit with an $IC_{50}$ of less than 100 μM.

An Rγc ligand can comprise the amino acid sequence of Formula (17) (SEQ ID NO: 1131), Formula (17a) (SEQ ID NO: 1132), Formula (17b) (SEQ ID NO: 1133), Formula (17c) (SEQ ID NO: 1134), Formula (17d) (SEQ ID NO: 1135), or Formula (17e) (SEQ ID NO: 1136):

$$-X^1-X^2-X^3-X^4-X^5-C-X^6-X^7-X^8-X^9-X^{10}-X^{11}-X^{12}-X^{13}-C-X^{14}-X^{15}-X^{16}-X^{17}-X^{18}- \quad (17)$$

$$-X^2-X^3-X^4-X^5-C-X^6-X^7-X^8-X^9-X^{10}-X^{11}-X^{12}-X^{13}-C-X^{14}-X^{15}-X^{16}-X^{17}- \quad (17a)$$

$$-X^3-X^4-X^5-C-X^6-X^7-X^8-X^9-X^{10}-X^{11}-X^{12}-X^{13}-C-X^{14}-X^{15}-X^{16}- \quad (17b)$$

$$-X^4-X^5-C-X^6-X^7-X^8-X^9-X^{10}-X^{11}-X^{12}-X^{13}-C-X^{14}-X^{15}- \quad (17c)$$

$$-X^5-C-X^6-X^7-X^8-X^9-X^{10}-X^{11}-X^{12}-X^{13}-C-X^{14}- \quad (17d)$$

$$-C-X^6-X^7-X^8-X^9-X^{10}-X^{11}-X^{12}-X^{13}-C- \quad (17e)$$

wherein, $X^1$ can be selected from an amino acid comprising a basic side chain;

$X^2$ can be selected from an amino acid comprising a hydroxyl-containing side chain;

$X^3$ can be selected from an amino acid comprising an acidic side chain or a large hydrophobic side chain;

$X^4$ can be selected from an amino acid comprising a large hydrophobic side chain;

$X^5$ can be selected from an amino acid comprising an acidic side chain or a large hydrophobic side chain;

$X^6$ can be selected from an amino acid comprising an acidic side chain or a polar/neutral side chain;

$X^7$ can be selected from an amino acid comprising an acidic side chain;

$X^8$ can be selected from an amino acid comprising a large hydrophobic side chain or an aromatic side chain;

$X^9$ can be selected from an amino acid comprising an acidic side chain or a polar/neutral side chain;

$X^{10}$ can be G;

$X^{11}$ can be V;

$X^{12}$ can be E;

$X^{13}$ can be L;

$X^{14}$ can be W;

$X^{15}$ can be selected from an amino acid comprising a large hydrophobic side chain;

$X^{16}$ can be E;

$X^{17}$ can be selected from an amino acid; and $X^{18}$ can be selected from an amino acid comprising an acidic side chain.

In Rγc ligands of Formula (17)-(17e), $X^1$ can be selected from H, K, and R;

$X^2$ can be selected from S, T, and Y;

$X^3$ can be selected from D, E, F, I, L, M, V, W, and Y;

$X^4$ can be selected from F, I, L, M, V, W, and Y;

$X^5$ can be selected from D, E, F, I, L, M, V, W, and Y;

$X^6$ can be selected from D, E, H, N, Q, S, T, and Y;

$X^7$ can be selected from D and E;

$X^8$ can be selected from F, H, I, L, M, V, W, and Y;

$X^9$ can be selected from D, E, H, N, Q, S, T, and Y;

$X^{10}$ can be G;

$X^{11}$ can be V;

$X^{12}$ can be E;

$X^{13}$ can be L;

$X^{14}$ can be W;

$X^{15}$ can be selected from F, I, L, M, V, W, Y, H, N, Q, S, and T;

$X^{16}$ can be E;

$X^{17}$ can be selected from an amino acid; and $X^{18}$ can be selected from D and E.

In Rγc ligands of Formula (17)-(17e), $X^1$ can be selected from D, E, G, H, K, M, N, P, Q, R, S, and T;

$X^2$ can be selected from A, D, E, G, I, K, L, P, Q, R, S, T, V, W, and Y;

$X^3$ can be selected from A, D, E, F, G, I, Q, S, T, V, W, and Y;

$X^4$ can be selected from A, I, E, I, L, M, N, Q, R, S, T, and V;

$X^5$ can be selected from A, E, I, L, M, N, Q, R, S, T, and V;

$X^6$ can be selected from D, E, H, L, Q, R, and V;

$X^7$ can be selected from D, E, N, T, and V;

$X^8$ can be selected from F, S, W, and Y;

$X^9$ can be selected from A, D, E, G, H, K, N, Q, R, and Y;

$X^{10}$ can be selected from G and R;

$X^{11}$ can be V;

$X^{12}$ can be selected from D, E, and Y;

$X^{13}$ can be selected from F, I, and L;

$X^{14}$ can be W;

$X^{15}$ can be selected from C, H, I, L, P, Q, T, V, and Y;

$X^{16}$ can be selected from A, D, E, G, M, R, S, T, and V;

$X^{17}$ can be selected from A, D, E, F, G, I, M, N, P, Q, R, S, T, V, W, and Y; and $X^{18}$ can be selected from A, C, D, E, F, G, I, K, L, N, P, Q, R, S, and V.

In Rγc ligands of Formula (17)-(17e), $X^1$ can be selected from H, K, and R;

$X^2$ can be selected from S, T, and Y;

$X^3$ can be selected from D, E, F, I, and V;

$X^4$ can be selected from I and V;

$X^5$ can be selected from E, I, L, M, and V;

$X^6$ can be selected from D, E, and Q;

$X^7$ can be selected from D and E;

$X^8$ can be selected from F and W;

$X^9$ can be selected from D, E, N, and Q;

$X^{10}$ can be G;

$X^{11}$ can be V;

$X^{12}$ can be selected from D and E;

$X^{13}$ can be L;

$X^{14}$ can be W;

$X^{15}$ can be selected from I, L, Q, and V;

$X^{16}$ can be selected from D and E;

$X^{17}$ can be selected from A, D, E, F, G, I, M, N, P, Q, R, S, T, V, W, and Y; and $X^{18}$ can be selected from D, E, N, and Q.

In Rγc ligands of Formula (17)-(17e), $X^1$ can be selected from K and R;

$X^2$ can be selected from S, T, and Y;

$X^3$ can be selected from D, E, F, I, and V;

$X^4$ can be V;

$X^5$ can be selected from E, L, M, and V;

$X^6$ can be Q;

$X^7$ can be selected from D and E;

$X^8$ can be W;

$X^9$ can be selected from D, E, N, and Q;

$X^{10}$ can be G;

$X^{11}$ can be V;

$X^{12}$ can be E;

$X^{13}$ can be L;

$X^{14}$ can be W;

$X^{15}$ can be selected from I, L, Q, and V;

$X^{16}$ can be selected from D and E;

$X^{17}$ can be selected from A, D, E, F, G, I, M, N, P, Q, R, S, T, V, W, and Y; and $X^{18}$ can be selected from D, E, N, and Q.

In Rγc ligands of Formula (17)-(17e), $X^1$ can be selected from H, K, and R.

In Rγc ligands of Formula (17)-(17e), $X^2$ can be selected from S, T, and Y.

In Rγc ligands of Formula (17)-(17e), $X^3$ can be selected from D, E, F, I, L, M, V, W, and Y.

In Rγc ligands of Formula (17)-(17e), $X^3$ can be selected from D and E.

In Rγc ligands of Formula (17)-(17e), $X^3$ can be selected from F, I, L, M, V, W, and Y.

In Rγc ligands of Formula (17)-(17e), $X^4$ can be selected from F, I, L, M, V, W, and Y.
In Rγc ligands of Formula (17)-(17e), $X^4$ can be V.
In Rγc ligands of Formula (17)-(17e), $X^5$ can be selected from D, E, F, I, L, M, V, W, and Y.
In Rγc ligands of Formula (17)-(17e), $X^5$ can be selected from D and E.
In Rγc ligands of Formula (17)-(17e), $X^5$ can be selected from F, I, L, M, V, W, and Y.
In Rγc ligands of Formula (17)-(17e), $X^6$ can be selected from D, E, H, N, Q, S, T, and Y.
In Rγc ligands of Formula (17)-(17e), $X^6$ can be selected from E and Q.
In Rγc ligands of Formula (17)-(17e), $X^7$ can be selected from D and E.
In Rγc ligands of Formula (17)-(17e), $X^8$ can be selected from F, H, I, L, M, V, W, and Y.
In Rγc ligands of Formula (17)-(17e), $X^8$ can be selected from F, H, W, and Y.
In Rγc ligands of Formula (17)-(17e), $X^8$ can be W.
In Rγc ligands of Formula (17)-(17e), $X^9$ can be selected from D, E, H, N, Q, S, T, and Y.
In Rγc ligands of Formula (17)-(17e), $X^9$ can be selected from D, E, and Q.
In Rγc ligands of Formula (17)-(17e), $X^{10}$ can be G.
In Rγc ligands of Formula (17)-(17e), $X^{11}$ can be V.
In Rγc ligands of Formula (17)-(17e), $X^{12}$ can be E.
In Rγc ligands of Formula (17)-(17e), $X^{13}$ can be L.
In Rγc ligands of Formula (17)-(17e), $X^{14}$ can be W.
In Rγc ligands of Formula (17)-(17e), $X^{15}$ can be selected from F, I, L, M, V, W, and Y.
In Rγc ligands of Formula (17)-(17e), $X^{15}$ can be L.
In Rγc ligands of Formula (17)-(17e), $X^{16}$ can be E.
In Rγc ligands of Formula (17)-(17e), $X^{17}$ can be selected from an amino acid.
In Rγc ligands of Formula (17)-(17e), $X^{18}$ can be selected from D and E.
In Rγc ligands of Formula (17)-(17e), the Rγc ligand can be defined by any combination of $X^1$-$X^{18}$ as defined in the immediately preceding twenty eight (28) paragraphs.
In Rγc ligands of Formula (17)-(17e),
$X^1$ can be selected from H, K, and R;
$X^2$ can be selected from S, T, and Y;
$X^3$ can be selected from D, E, F, I, L, M, V, W, and Y;
$X^4$ can be selected from F, I, L, M, V, W, and Y;
$X^5$ can be selected from D, E, F, I, L, M, V, W, and Y;
$X^6$ can be selected from D, E, H, N, Q, S, T, and Y;
$X^7$ can be selected from D and E;
$X^8$ can be selected from F, H, I, L, M, V, W, and Y;
$X^9$ can be selected from D, E, H, N, Q, S, T, and Y;
$X^{10}$ can be G;
$X^{11}$ can be V;
$X^{12}$ can be E;
$X^{13}$ can be L;
$X^{14}$ can be selected from W;
$X^{15}$ can be selected from F, I, L, M, V, W, and Y;
$X^{16}$ can be E;
$X^{17}$ can be selected from an amino acid; and
$X^{18}$ can be selected from D and E.
In Rγc ligands of Formula (17)-(17e),
$X^1$ can be selected from H, K, and R;
$X^2$ can be selected from S, T, and Y;
$X^3$ can be selected from D and E;
$X^4$ can be V;
$X^5$ can be selected from D and E;
$X^6$ can be selected from E and Q;
$X^7$ can be selected from D and E;
$X^8$ can be selected from F, H, W, and Y;
$X^9$ can be selected from D, E, and Q;
$X^{10}$ can be G;
$X^{11}$ can be V;
$X^{12}$ can be E;
$X^{13}$ can be L;
$X^{14}$ can be W;
$X^{15}$ can be selected from F, I, L, M, V, W, Y, H, N, Q, S, and T;
$X^{16}$ can be E;
$X^{17}$ can be selected from an amino acid; and
$X^{18}$ can be selected from D and E.
In Rγc ligands of Formula (17)-(17e),
$X^1$ can be selected from H, K, and R;
$X^2$ can be selected from S, T, and Y;
$X^3$ can be selected from F, I, L, M, V, W, and Y;
$X^4$ can be V;
$X^5$ can be selected from F, I, L, M, V, W, and Y;
$X^6$ can be selected from E and Q;
$X^7$ can be selected from D and E;
$X^8$ can be selected from F, H, W, and Y;
$X^9$ can be selected from D, E, and Q;
$X^{10}$ can be G;
$X^{11}$ can be V;
$X^{12}$ can be E;
$X^{13}$ can be L;
$X^{14}$ can be W;
$X^{15}$ can be selected from F, I, L, M, V, W, Y, H, N, Q, S, and T;
$X^{16}$ can be E;
$X^{17}$ can be selected from an amino acid; and
$X^{18}$ can be selected from D and E.
In Rγc ligands of Formula (17)-(17e),
$X^1$ can be selected from H, K, and R;
$X^2$ can be selected from S, T, and Y;
$X^3$ can be selected from D, E, F, I, L, M, V, W, and Y;
$X^4$ can be V;
$X^5$ can be selected from D, E, F, I, L, M, V, W, and Y;
$X^6$ can be selected from D, E, H, N, Q, S, T, and Y;
$X^6$ can be selected from E and Q;
$X^7$ can be selected from D and E;
$X^8$ can be W;
$X^9$ can be selected from D, E, and Q;
$X^{10}$ can be G;
$X^{11}$ can be V;
$X^{12}$ can be E;
$X^{13}$ can be L;
$X^{14}$ can be W;
$X^{15}$ can be selected from F, I, L, M, V, W, Y, H, N, Q, S, and T;
$X^{16}$ can be E;
$X^{17}$ can be selected from an amino acid; and
$X^{18}$ can be selected from D and E.

An Rγc ligand can comprise an amino acid sequence selected from any one of SEQ ID NOS: 1137-1215:

SEQ ID NO: 1137
A H S R Q E V V C E E W Y G V E L C W I

SEQ ID NO: 1138
A N Q N T V V E C Q D W H G V E L C W Q

SEQ ID NO: 1139
A V C Q D W Y G V E L C W C M Q D I L D

SEQ ID NO: 1140
D V E C V D W G G V E L C W H

DFERSYVVCQDWDGVELCWI SEQ ID NO: 1141

DVVCQNWEGVDLCWH SEQ ID NO: 1142

DWRRSVVECQDWYGVELCWQ SEQ ID NO: 1143

DVVCQNWDGVDLCWH SEQ ID NO: 1144

DRQVVCEEWDGVELCWIEES SEQ ID NO: 1145

ERPRSFIECQEWEGVELCWL SEQ ID NO: 1146

EGSTTTIECEEWAGVELCWL SEQ ID NO: 1147

EQQVVCQEWNGVELCWIEAG SEQ ID NO: 1148

FAHHGVVECQEWYGVELCWQ SEQ ID NO: 1149

GQGREVVVCHDWYGVELCWQ SEQ ID NO: 1150

GDRPKEVVCEDWKGVELCWI SEQ ID NO: 1151

GNDDSYIVCEEWKGVELCWI SEQ ID NO: 1152

GLEIACEDWYGVELCWLRRA SEQ ID NO: 1153

GYGVLCQEWQGVELCWPVQREAGV SEQ ID NO: 1154

GPEVVCEEFNRVELCWVEYN SEQ ID NO: 1155

GYGVVCEDFRGVELCWLERK SEQ ID NO: 1156

HEAREVVVCQDWYGVELCWQ SEQ ID NO: 1157

HSTVICQDWDGVELCWIEND SEQ ID NO: 1158

IECDTSYGVYICWQ SEQ ID NO: 1159

IECEEWRGVELCWQ SEQ ID NO: 1160

IWGRTVVECQDWEGVELCWQ SEQ ID NO: 1161

IVCEEWRGVELCWL SEQ ID NO: 1162

IVCEDWRGVELCWI SEQ ID NO: 1163

IECEEWAGVELCWL SEQ ID NO: 1164

ILCQEFEGVELCWLEESLAE SEQ ID NO: 1165

IMCQEWDGVELCWLERDKAN SEQ ID NO: 1166

INCQTWNGVELCWVDEGLYQ SEQ ID NO: 1167

IVCEEYNGVELCWVETSVKP SEQ ID NO: 1168

ILCEEWQGVELCWLEGGGS SEQ ID NO: 1169

KSQVECQDWEGVELCWVVSE SEQ ID NO: 1170

KITVECQDWDGVELCWPTWI SEQ ID NO: 1171

KLTVECQDWDGVELCWVGVE SEQ ID NO: 1172

KTTVACQDWGGVELCWVERV SEQ ID NO: 1173

KPVVCEEWQGVELCWLEIQ SEQ ID NO: 1174

KYIVECQEWGGVELCWPEMV SEQ ID NO: 1175

KKIVVCQDWGGVELCWTEDD SEQ ID NO: 1176

LALRKEVVCQEYYGVELCWI SEQ ID NO: 1177

LNRSVWIECEEYEGVELCWL SEQ ID NO: 1178

MVNREVVVCEDWYGVELCWQ SEQ ID NO: 1179

PEGREVVVCRDWYGVELCWQ SEQ ID NO: 1180

PYGVVCQDWAGVELCWVENR SEQ ID NO: 1181

PVEVRCQEWEGVELCWVVGI SEQ ID NO: 1182

QLGVECQNWRGVELCWVSEI SEQ ID NO: 1183

RLLNSVVECLDWEGVELCWQ SEQ ID NO: 1184

RSDDEVVVCQEWEGVELCWQ SEQ ID NO: 1185

RSNQTVVECQDWEGVELCWQ SEQ ID NO: 1186

RPQIECQEWQGVELCWTREE SEQ ID NO: 1187

RVQVECEDWNGVELCWPVRV SEQ ID NO: 1188

RPEVVCQEWEGVELCWISPL SEQ ID NO: 1189

RLGVECQEWEGVDLCWISAF SEQ ID NO: 1190

RWAVSCQDWQGIELCWPEWD SEQ ID NO: 1191

RTGVECQDWHGVELCWPVWE SEQ ID NO: 1192

RTEVECEDWEGVELCWL SEQ ID NO: 1193

SAPERWVECEDWQGVELCWV SEQ ID NO: 1194

-continued

SEQ ID NO: 1195
S A G R Q E V V C Q D W N G V E L C W I

SEQ ID NO: 1196
S P S I V C E E W A G V E L C W V D Y S

SEQ ID NO: 1197
S V E V V C E E W H G V E L C W P V F I

SEQ ID NO: 1198
T A N Q T V V E C Q V W G G V E L C W Q

SEQ ID NO: 1199
T L G R T V V E C Q D W G G V E L C W Q

SEQ ID NO: 1200
T W N M S E L E C Q D W N G V E I C W H

SEQ ID NO: 1201
T D E V S C Q E W E G V E L C W I E R Q

SEQ ID NO: 1202
T A E V V C Q E W D G V E L C W I E V L

SEQ ID NO: 1203
V E C Q E W G G V E L C W C

SEQ ID NO: 1204
V V C Q D W E G V E L C W Q

SEQ ID NO: 1205
V V C Q E W E G V E L C W C

SEQ ID NO: 1206
V V C Q E W E G V E L C W Y A G E C M Q

SEQ ID NO: 1207
V S C Q E W D G V E L C W V D G D L A A

SEQ ID NO: 1208
V V C Q E W E G V E L C W V E P P L L P

SEQ ID NO: 1209
V V C E V F Q G V E L C W C E N E E F T

SEQ ID NO: 1210
V T C Q E Y E G V E L C W T V G C A Y S

SEQ ID NO: 1211
V V C Q E W E G V E L C W Q T G P G A H A

SEQ ID NO: 1212
V E C E E W G G V E L C W L A D E V M W

SEQ ID NO: 1213
V G I E C E E W A G V E L C W L

SEQ ID NO: 1214
W S K K A E V V C E E W G G V E F C W I

SEQ ID NO: 1215
Y S R E L Y V Q C E D W E G V E L C W I

An Rγc ligand provided by the present disclosure can comprise a truncated amino acid sequence of any one of SEQ ID NOS: 1131-1215.

An Rγc ligand provided by the present disclosure can comprise an amino acid sequence selected from any one of SEQ ID NOS: 1131-1215, or a truncated amino acid sequence of any one of SEQ ID NOS: 1131-1215, wherein the amino acid sequence can independently comprise from 1 to 4 glycines (G) (SEQ ID NO: 9615) on the N-terminus, on the C-terminus, or on both the N- and C-termini.

An Rγc ligand provided by the present disclosure can comprise an amino acid sequence selected from any one of SEQ ID NOS: 1131-1215, or a truncated amino acid sequence of any one of SEQ ID NOS: 1131-1215, wherein the amino acid sequence comprises one or more amino acid substitutions such as from 1 to 5 amino acid substitutions. The amino acid substitutions can comprise conservative amino acid substitutions.

An Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 1131-1215 or to a truncated amino acid sequence of any one of SEQ ID NOS: 1131-1215.

An Rγc ligand of any one of SEQ ID NOS: 1131-1215, a truncated Rγc ligand of any one of SEQ ID NOS: 1131-1215, or a substituted Rγc ligand of any one of SEQ ID NOS: 1131-1215 bind to the hRγc subunit with an $IC_{50}$ of less than 100 μM or less than 10 μM as determined using phage ELISA competition assays.

An Rγc ligand of any one of SEQ ID NOS: 1137-1215 binds to the hRγc subunit with an $IC_{50}$ of less than 100 μM.

An Rγc ligand can have any one of SEQ ID NOS: 1601-1613:

SEQ ID NO: 1601
G G D C S M W E G V E L C W G G

SEQ ID NO: 1602
G G V M C E R W Q G V E L C W L G G

SEQ ID NO: 1603
G G V G I E C E E W A G V E L C W L G G

SEQ ID NO: 1604
G G T W N M S E L E C Q D W N G V E I C W H G G

SEQ ID NO: 1605
G G R T E V E C E D W E G V E L C W L G G

SEQ ID NO: 1606
G G R T G V E C Q D W H G V E L C W P V W E G G

SEQ ID NO: 1607
G G V V C Q D W E G V Abu L C W Q G G

SEQ ID NO: 1608
G G V V C Q D W E G V Alb L C W Q G G

SEQ ID NO: 1609
G G V V C Q D W E G V D A L C W Q G G

SEQ ID NO: 1610
G G V V C Q D W E G V S L C W Q G G

SEQ ID NO: 1611
G G V V C Q D W E G V G L C W Q G G

SEQ ID NO: 1612
G G V V C Q D W E G V E L C W Q P P A

SEQ ID NO: 1613
G G V V C Q D W E G V E L C W Q G P P A

An Rγc ligand provided by the present disclosure can comprise a truncated amino acid sequence of any one of SEQ ID NOS: 1601-1613.

An Rγc ligand provided by the present disclosure can comprise an amino acid sequence selected from any one of SEQ ID NOS: 1601-1613, or a truncated amino acid sequence of any one of SEQ ID NOS: 1601-1613, wherein the amino acid sequence can independently comprise from 1 to 4 glycines (G) (SEQ ID NO: 9615) on the N-terminus, on the C-terminus, or on both the N- and C-termini.

An Rγc ligand provided by the present disclosure can comprise an amino acid sequence selected from any one of SEQ ID NOS: 1601-1613, or a truncated amino acid sequence of any one of SEQ ID NOS: 1601-1613, wherein the amino acid sequence comprises one or more amino acid substitutions such as from 1 to 5 amino acid substitutions. The amino acid substitutions can comprise conservative amino acid substitutions.

An Rγc ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 1601-1613 or to a truncated amino acid sequence of any one of SEQ ID NOS: 1601-1613.

An Rγc ligand of any one of SEQ ID NOS: 1601-1613, a truncated Rγc ligand of any one of SEQ ID NOS: 1601-1613, or a substituted Rγc ligand of any one of SEQ ID NOS: 1601-1613 bind to the hRγc subunit with an $IC_{50}$ of less than 100 μM or less than 10 μM as determined using phage ELISA competition assays.

An Rγc ligand of any one of SEQ ID NOS: 1601-1613 binds to the hRγc subunit with an $IC_{50}$ of less than 100 μM.

Certain Rγc ligands provided by the present disclosure can bind to a specific binding site on the Rγc subunit that is different than the Rγc binding site on the Rγc subunit to which IL-2 or IL-7 binds.

These Rγc ligands do not compete for binding to the specific Rγc binding site with IL-2 or IL-7, have no detectable binding to the IL-7Rα subunit, and bind to the Rγc subunit with an $IC_{50}$ of less than 10 μM.

The specific binding site on the Rγc subunit can be characterized by at least the following properties: (1) a group of Rγc ligands bind to the specific binding site on the Rγc subunit with an $IC_{50}$ of less than 10 μM; (2) Rγc ligands within the group competitively bind to the specific binding site on the Rγc subunit with each of the other Rγc ligands within the group; and (3) Rγc ligands within the group do not compete for binding to the specific binding site with an Rγc ligand having the amino acid sequence of SEQ ID NO: 1128.

An IL-7Rα ligand having the amino acid sequence of SEQ ID NO: 154 does not compete for binding to the binding site with the group of Rγc ligands.

The group of Rγc ligands comprises Rγc ligands having an amino acid sequence of SEQ ID NOS: 1011, 1021, 1034, 1071, 1079, and 1109.

Rγc ligands within the group of Rγc ligands can bind to the Rγc subunit with an $IC_{50}$ of less than 100 μM and can bind to the Rα subunit with an $IC_{50}$ of greater than 100 μM.

The specific binding site of the Rγc subunit for these Rγc ligands can be characterized using competitive binding assays as described, for example, in Example 40.

An IL-7Rα ligand provided by the present disclosure can comprise an IL-7Rα ligand of any one of SEQ ID NOS: 2001-2410, a truncated amino acid sequence of any one of SEQ ID NOS: 2001-2410, a substituted amino acid sequence of any one of SEQ ID NOS: 2001-2410, or a truncated amino acid sequence of any one of SEQ ID NOS: 2001-2410, or an amino acid sequence having a sequence similarity greater than greater than 60%, greater than 70%, greater than 75%, greater than 80%, greater than 85%, greater than 90%, or greater than 95% to any of the foregoing.

An IL-7Rα ligand provided by the present disclosure can bind to the human IL-7Rα subunit with an $IC_{50}$, for example, of less than 100 μM, less than 10 μM, less than 1 μM, less than 100 nM, less than 10 nM, or less than 1 nM.

An IL-7Rα ligand can bind to the human IL-7Rα subunit with an $IC_{50}$, for example, from 1 μM to 100 μM, from 10 pM to 1 uM, from 100 pM to 1 μM, from 1 nM to 1 μM, or from 10 nM to 1 μM.

An IL-7Rα ligand provided by the present disclosure can bind to a mammalian IL-7Rα subunit with an $IC_{50}$, for example, of less than 100 μM, less than 10 μM, less than 1 μM, less than 100 nM, less than 10 nM, or less than 1 nM.

An IL-7Rα ligand can bind to a mammalian IL-7Rα subunit with an $IC_{50}$, for example, from 1 μM to 100 μM, from 10 pM to 10 μM, from 100 pM to 1 μM, from 1 nM to 1 μM, or from 10 nM to 1 μM.

An IL-7Rα ligand provided by the present disclosure can comprise an amino acid sequence encompassed by any one of Formula (21) to (29c).

An IL-7Rα ligand provided by the present disclosure can comprise an amino acid sequence of any one of SEQ ID NO: 2001-2410.

An IL-7Rα ligand provided by the present disclosure can comprise an amino acid sequence of any one of SEQ ID NO: 2011-2410 independently having one or more of the following conservative substitutions: amino acids having a small hydrophobic side chain comprising alanine (A), glycine (G), proline (P), serine (S) or threonine (T), or tyrosine (Y); amino acids having a hydroxyl-containing side chain comprising serine (S), threonine (T); amino acids having an acidic side chain comprising aspartate (D) or glutamate (E); amino acids having a polar neutral side chain comprising histidine (H), asparagine (N), glutamine (Q), serine (S), threonine (T), or tyrosine (Y); amino acids having a basic side chain comprising arginine (R), lysine (K), or histidine (H); amino acids having a large hydrophobic side chain comprising isoleucine (I), leucine (L), methionine (M), valine (V), phenylalanine (F), tyrosine (Y), or tryptophan (W); and amino acids having an aromatic side chain comprising phenylalanine (F), histidine (H), tryptophan (W), or tyrosine (Y).

An IL-7Rα ligand provided by the present disclosure can have, for example, greater than 60%, greater than 70%, greater than 80%, or greater than 90% sequence similarity to any one of SEQ ID NO: 2001-2410.

An IL-7Rα ligand can comprise an amino acid sequence of any one of SEQ ID NOS: 2001-2008, which are referred to as Family 1 IL-7Rα ligands.

An IL-7Rα ligand can comprise the amino acid sequence of Formula (21) (SEQ ID NO: 2001), an amino acid sequence of Formula (21a) (SEQ ID NO: 2002), or an amino acid sequence of Formula (21b) (SEQ ID NO: 2003):

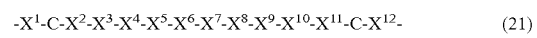

$$-X^1-C-X^2-X^3-X^4-X^5-X^6-X^7-X^8-X^9-X^{10}-X^{11}-C-X^{12}- \qquad (21)$$

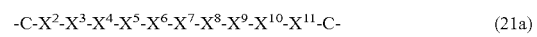

$$-C-X^2-X^3-X^4-X^5-X^6-X^7-X^8-X^9-X^{10}-X^{11}-C- \qquad (21a)$$

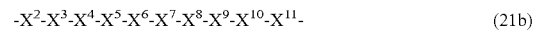

$$-X^2-X^3-X^4-X^5-X^6-X^7-X^8-X^9-X^{10}-X^{11}- \qquad (21b)$$

wherein $X^1$ can be selected from an amino acid comprising a small hydrophobic side chain;

$X^2$ can be selected from an amino acid comprising a polar/neutral side chain and an amino acid comprising a large hydrophobic side chain;

$X^3$ can be selected from an amino acid comprising a large hydrophobic side chain;

$X^4$ can be selected from an amino acid comprising a large hydrophobic side chain;

$X^5$ can be selected from an amino acid comprising an acidic side chain;

$X^6$ can be selected from an amino acid comprising a large hydrophobic side chain;

$X^7$ can be selected from an amino acid comprising an acidic side chain;

$X^8$ can be selected from an amino acid comprising a small hydrophobic side chain;
$X^9$ can be an amino acid comprising a large hydrophobic side chain;
$X^{10}$ can be an amino acid comprising a large hydrophobic side chain;
$X^{11}$ can be selected from an amino acid comprising a small hydrophobic side chain and an amino acid comprising a large hydrophobic side chain; and
$X^{12}$ can be selected from an amino acid.

In IL-7Rα ligands of Formula (21)-(21b), $X^1$ can be selected from P, Q, S, T, and Y.
In IL-7Rα ligands of Formula (21)-(21b), $X^2$ can be selected from F, I, P, Q, and S.
In IL-7Rα ligands of Formula (21)-(21b), $X^3$ can be selected from H and V.
In IL-7Rα ligands of Formula (21)-(21b), $X^3$ can be H.
In IL-7Rα ligands of Formula (21)-(21b), $X^4$ can be selected from H, Q, W, and Y.
In IL-7Rα ligands of Formula (21)-(21b), $X^4$ can be W.
In IL-7Rα ligands of Formula (21)-(21b), $X^5$ can be selected from D and P.
In IL-7Rα ligands of Formula (21)-(21b), $X^5$ can be D.
In IL-7Rα ligands of Formula (21)-(21b), $X^6$ can be selected from E, I, L, and V.
In IL-7Rα ligands of Formula (21)-(21b), $X^6$ can be L.
In IL-7Rα ligands of Formula (21)-(21b), $X^7$ can be selected from D, E, and Q.
In IL-7Rα ligands of Formula (21)-(21b), $X^7$ can be E.
In IL-7Rα ligands of Formula (21)-(21b), $X^8$ can be selected from D, G, S, and T.
In IL-7Rα ligands of Formula (21)-(21b), $X^8$ can be T.
In IL-7Rα ligands of Formula (21)-(21b), $X^9$ can be L.
In IL-7Rα ligands of Formula (21)-(21b), $X^{10}$ can be selected from A, M, and L.
In IL-7Rα ligands of Formula (21)-(21b), $X^{10}$ can be L.
In IL-7Rα ligands of Formula (21)-(21b), $X^{11}$ can be selected from A, S and V.
In IL-7Rα ligands of Formula (21)-(21b), $X^{11}$ can be selected from S and V.
In IL-7Rα ligands of Formula (21)-(21b), $X^{12}$ can be selected from A, I, R, T, and V.
In IL-7Rα ligands of Formula (21)-(21b), the IL-7Rα ligand can be defined by any combination of $X^1$-$X^{12}$ as defined in the immediately preceding twenty (20) paragraphs.

In IL-7Rα ligands of Formula (21)-(21b),
$X^1$ can be selected from P, Q, S, T, and Y;
$X^2$ can be selected from F, I, P, Q, and S;
$X^3$ can be selected from H and V;
$X^4$ can be selected from H, Q, W, and Y;
$X^5$ can be selected from D and P;
$X^6$ can be selected from E, I, L, and V;
$X^7$ can be selected from D, E, and Q;
$X^8$ can be selected from D, G, S, and T;
$X^9$ can be L;
$X^{10}$ can be selected from A, M, and L;
$X^{11}$ can be selected from A, S, and V; and
$X^{12}$ can be selected from A, I, R, T, and V.

In IL-7Rα ligands of Formula (21)-(21b),
$X^1$ can be selected from P, Q, S, T, and Y;
$X^2$ can be selected from F, I, P, Q, and S;
$X^3$ can be H;
$X^4$ can be W;
$X^5$ can be D;
$X^6$ can be L;
$X^7$ can be E;
$X^8$ can be T;
$X^9$ can be L;
$X^{10}$ can be L;
$X^{11}$ can be selected from S and V; and
$X^{12}$ can be selected from A, I, R, T, and V.

In IL-7Rα ligands of Formula (21)-(21b),
$X^1$ can be selected from an amino acid;
$X^2$ can be selected from an amino acid;
$X^3$ can be H;
$X^4$ can be selected from an amino acid comprising an aromatic side chain;
$X^5$ can be D;
$X^6$ can be selected from an amino acid comprising a large hydrophobic side chain;
$X^7$ can be selected from D and E;
$X^8$ can be selected from an amino acid;
$X^9$ can be L;
$X^{10}$ can be selected from L and M;
$X^{11}$ can be selected from an amino acid; and
$X^{12}$ can be selected from an amino acid.

An IL-7Rα ligand can comprise the amino acid sequence of any one of SEQ ID NO: 2004-2008:

```
                                    SEQ ID NO: 2004
     P C F V Y P E E D L L V C R

SEQ ID NO: 2005
     Q C I H W D I E T L L S C V

SEQ ID NO: 2006
     S C S H W D V E S L A V C T

SEQ ID NO: 2007
     T C Q H Q D L Q G L L A C I

SEQ ID NO: 2008
     Y C P H H D L D T L M S C A
```

An IL-7Rα ligand provided by the present disclosure can comprise a truncated amino acid sequence of any one of SEQ ID NOS: 2001-2008.

An IL-7Rα ligand provided by the present disclosure can comprise an amino acid sequence selected from any one of SEQ ID NOS: 2001-2008, or a truncated amino acid sequence of any one of SEQ ID NOS: 2001-2008, wherein the amino acid sequence can independently comprise from 1 to 4 glycines (G) (SEQ ID NO: 9615) on the N-terminus, on the C-terminus, or on both the N- and C-termini.

An IL-7Rα ligand provided by the present disclosure can comprise an amino acid sequence selected from any one of SEQ ID NOS: 2001-2008, or a truncated amino acid sequence of any one of SEQ ID NOS: 2001-2008, wherein the amino acid sequence comprises one or more amino acid substitutions such as from 1 to 5 amino acid substitutions. The amino acid substitutions can comprise conservative amino acid substitutions.

An IL-7Rα ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2001-2008 or to a truncated amino acid sequence of any one of SEQ ID NOS: 2001-2008.

An IL-7Rα ligand of any one of SEQ ID NOS: 2001-2008, a truncated IL-7Rα ligand of any one of SEQ ID NOS: 2001-2008, or a substituted IL-7Rα ligand of any one of SEQ ID NOS: 2001-2008 can bind to the hIL-7Rα subunit with an $IC_{50}$ of less than 100 μM or less than 10 μM as determined using phage ELISA competition assays.

An IL-7Rα ligand of any one of SEQ ID NOS: 2004-2008 exhibited a binding affinity ($IC_{50}$) to the hIL-7Rα subunit of less than 100 μM.

An IL-7Rα ligand can comprise an amino acid sequence of any one of SEQ ID NOS: 2009-20021, which are referred to as Family 2 IL-7Rα ligands.

An IL-7Rα ligand can comprise an amino acid sequence of Formula (22) (SEQ ID NO: 2009), an amino acid sequence of Formula (22a) (SEQ ID NO: 2010), an amino acid sequence of Formula (22b) (SEQ ID NO: 2011), an amino acid sequence of Formula (22c) (SEQ ID NO: 2012), or an amino acid sequence of Formula (22d) (SEQ ID NO: 2013):

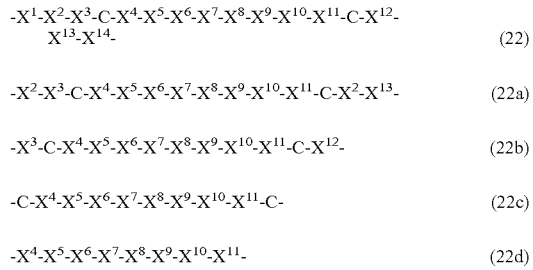

$$-X^1-X^2-X^3-C-X^4-X^5-X^6-X^7-X^8-X^9-X^{10}-X^{11}-C-X^{12}-X^{13}-X^{14}- \quad (22)$$

$$-X^2-X^3-C-X^4-X^5-X^6-X^7-X^8-X^9-X^{10}-X^{11}-C-X^2-X^{13}- \quad (22a)$$

$$-X^3-C-X^4-X^5-X^6-X^7-X^8-X^9-X^{10}-X^{11}-C-X^{12}- \quad (22b)$$

$$-C-X^4-X^5-X^6-X^7-X^8-X^9-X^{10}-X^{11}-C- \quad (22c)$$

$$-X^4-X^5-X^6-X^7-X^8-X^9-X^{10}-X^{11}- \quad (22d)$$

wherein, $X^1$ can be selected from an amino acid comprising a large hydrophobic side chain;

$X^2$ can be selected from an amino acid comprising an acidic side chain, an amino acid comprising a small hydrophobic side chain, and an amino acid comprising a large hydrophobic side chain;

$X^3$ can be selected from an amino acid comprising a large hydrophobic side chain;

$X^4$ can be selected from an amino acid;

$X^5$ can be selected from an amino acid comprising an acidic side chain and an amino acid comprising a large hydrophobic side chain;

$X^6$ can be selected from an amino acid comprising an acidic side chain and an amino acid comprising a large hydrophobic side chain;

$X^7$ can be P;

$X^8$ can be G;

$X^9$ can be selected from an amino acid comprising a small hydrophobic side chain and an amino acid comprising a large hydrophobic side chain;

$X^{10}$ can be selected from an amino acid comprising a small hydrophobic side chain and an amino acid comprising a large hydrophobic side chain;

$X^{11}$ can be selected from an amino acid comprising an acidic side chain, an amino acid comprising a polar/neutral side chain, and an amino acid comprising a large hydrophobic side chain;

$X^{12}$ can be selected from an amino acid;

$X^{13}$ can be selected from an amino acid comprising a polar/neutral side chain and an amino acid comprising an aromatic side chain; and $X^{14}$ can be selected from an amino acid comprising a polar/neutral side chain and an amino acid comprising a large hydrophobic side chain.

In IL-7Rα ligands of Formula (22)-(22d), $X^1$ can be selected from D, I, R, S, V, and Y.

In IL-7Rα ligands of Formula (22)-(22d), $X^1$ can be selected from D and V.

In IL-7Rα ligands of Formula (22)-(22d), $X^2$ can be selected from D, E, P, W, and Y.

In IL-7Rα ligands of Formula (22)-(22d), $X^2$ can be selected from P, W, and Y.

In IL-7Rα ligands of Formula (22)-(22d), $X^3$ can be selected from A, E, L, S, and W.

In IL-7Rα ligands of Formula (22)-(22d), $X^3$ can be selected from L and W.

In IL-7Rα ligands of Formula (22)-(22d), $X^4$ can be selected from A, D, R, S, T, and Y.

In IL-7Rα ligands of Formula (22)-(22d), $X^4$ can be selected from D, R, and T.

In IL-7Rα ligands of Formula (22)-(22d), $X^5$ can be selected from D, E, L, M, P, and T.

In IL-7Rα ligands of Formula (22)-(22d), $X^5$ can be L.

In IL-7Rα ligands of Formula (22)-(22d), $X^6$ can be selected from A, D, G, L, N, V, and W.

In IL-7Rα ligands of Formula (22)-(22d), $X^6$ can be D.

In IL-7Rα ligands of Formula (22)-(22d), $X^7$ can be P.

In IL-7Rα ligands of Formula (22)-(22d), $X^8$ can be G.

In IL-7Rα ligands of Formula (22)-(22d), $X^9$ can be selected from D, G, L, S, T, W, and Y.

In IL-7Rα ligands of Formula (22)-(22d), $X^9$ can be selected from G and S.

In IL-7Rα ligands of Formula (22)-(22d), $X^{10}$ can be selected from A, D, F, L, P, T, and V.

In IL-7Rα ligands of Formula (22)-(22d), $X^{10}$ can be L.

In IL-7Rα ligands of Formula (22)-(22d), $X^{11}$ can be selected from D, E, F, H, Q, R, V, and Y.

In IL-7Rα ligands of Formula (22)-(22d), $X^{11}$ can be Q.

In IL-7Rα ligands of Formula (22)-(22d), $X^{12}$ can be selected from A, E, L, Q, S, and V.

In IL-7Rα ligands of Formula (22)-(22d), $X^{12}$ can be selected from A and V.

In IL-7Rα ligands of Formula (22)-(22d), $X^{13}$ can be selected from D, F, H, I, S, T, V, and W.

In IL-7Rα ligands of Formula (22)-(22d), $X^{13}$ can be W.

In IL-7Rα ligands of Formula (22)-(22d), $X^{14}$ can be selected from F, I, L, M, Q, R, S, and T.

In IL-7Rα ligands of Formula (22)-(22d), $X^{14}$ can be F.

In IL-7Rα ligands of Formula (22)-(22d), the IL-7Rα ligand can be defined by any combination of $X^1$-$X^{14}$ as defined in the immediately preceding twenty six (26) paragraphs.

In IL-7Rα ligands of Formula (22)-(22d), $X^1$ can be selected from I and V;

$X^2$ can be selected from P, W, and Y;

$X^3$ can be selected from L and W;

$X^4$ can be selected from an amino acid;

$X^5$ can be selected from L and M;

$X^6$ can be D;

$X^7$ can be P;

$X^8$ can be G;

$X^9$ can be an amino acid;

$X^{10}$ can be selected from F, L, and V;

$X^{11}$ can be an amino acid;

$X^{12}$ can be an amino acid;

$X^1$ can be selected from F, H, and W; and $X^{14}$ can be selected from F, I, L, and M.

In IL-7Rα ligands of Formula (22)-(22d), $X^1$ can be V;

$X^2$ can be P;

$X^3$ can be W;

$X^4$ can be selected from an amino acid;

$X^5$ can be L;

$X^6$ can be D;

$X^7$ can be P;

$X^8$ can be G;

$X^9$ can be an amino acid;

$X^{10}$ can be selected from F, I, L, M, V, Y, and W;

$X^{11}$ can be an amino acid;

$X^{12}$ can be an amino acid;

$X^{13}$ can be selected from F, H, W, and Y; and $X^{14}$ can be selected from F, I, L, M, V, Y, and W.

An IL-7Rα ligand can comprise the amino acid sequence of any one of SEQ ID NOS: 2014-2021:

```
                              SEQ ID NO: 2014
D W L C R T D P G Y L D C V S F

SEQ ID NO: 2015
D W L C R P G P G L L V C Q W F

SEQ ID NO: 2016
I P W C T L W P G G P E C Q T L

SEQ ID NO: 2017
R Y E C A D L P G G L H C E F R

SEQ ID NO: 2018
S Y A C D M N P G W D F C S D T

SEQ ID NO: 2019
V P W C S L D P G S V Q C V H S

SEQ ID NO: 2020
V D W C D L A P G D F R C A W M

SEQ ID NO: 2021
V P W C T L D P G S T Q C A V I
```

An IL-7Rα ligand provided by the present disclosure can comprise a truncated amino acid sequence of any one of SEQ ID NOS: 2009-2021.

An IL-7Rα ligand provided by the present disclosure can comprise an amino acid sequence selected from any one of SEQ ID NOS: 2009-2021, or a truncated amino acid sequence of any one of SEQ ID NOS: 2009-2021, wherein the amino acid sequence can independently comprise from 1 to 4 glycines (G) (SEQ ID NO: 9615) on the N-terminus, on the C-terminus, or on both the N- and C-termini.

An IL-7Rα ligand provided by the present disclosure can comprise an amino acid sequence selected from any one of SEQ ID NOS: 2009-2021, or a truncated amino acid sequence of any one of SEQ ID NOS: 2009-2021, wherein the amino acid sequence comprises one or more amino acid substitutions such as from 1 to 5 amino acid substitutions. The amino acid substitutions can comprise conservative amino acid substitutions.

An IL-7Rα ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2009-2021 or a truncated amino acid sequence of any one of SEQ ID NOS: 2009-2021.

An IL-7Rα ligand of any one of SEQ ID NOS: 2009-2021 can bind to the hIL-7Rα subunit with an $IC_{50}$ of less than 10 µM as determined using phage ELISA competition assays.

An IL-7Rα ligand of any one of SEQ ID NOS: 2009-2021, a truncated IL-7Rα ligand of any one of SEQ ID NOS: 2009-2021, or a substituted IL-7Rα ligand of any one of SEQ ID NOS: 2009-2021 can bind to the hIL-7Rα subunit with an $IC_{50}$ of less than 100 µM or less than 10 µM as determined using phage ELISA competition assays.

An IL-7Rα ligand of any one of SEQ ID NOS: 2014-2021 exhibited a binding affinity ($IC_{50}$) to the hIL-7Rα subunit of less than 100 µM.

An IL-7Rα ligand can comprise an amino acid sequence of any one of SEQ ID NOS: 2022-2049, which are referred to as Family 3A IL-7Rα ligands.

An IL-7Rα ligand can comprise the amino acid sequence of Formula (23) (SEQ ID NO: 2022), an amino acid sequence of Formula (23a) (SEQ ID NO: 2023), an amino acid sequence of Formula (23b) (SEQ ID NO: 2024), an amino acid sequence of Formula (23c) (SEQ ID NO: 2025), or an amino acid sequence of Formula (23d) (SEQ ID NO: 2026):

$$-X^1-X^2-X^3-C-X^4-X^5-X^6-X^7-X^8-X^9-X^{10}-X^{11}-C-X^{12}-X^{13}- \quad (23)$$

$$-X^2-X^3-C-X^4-X^5-X^6-X^7-X^8-X^9-X^{10}-X^{11}-C-X^{12}-X^{13}- \quad (23a)$$

$$-X^3-C-X^4-X^5-X^6-X^7-X^8-X^9-X^{10}-X^{11}-C-X^2- \quad (23b)$$

$$-C-X^4-X^5-X^6-X^7-X^8-X^9-X^{10}-X^{11}-C- \quad (23c)$$

$$-X^4-X^5-X^6-X^7-X^8-X^9-X^{10}-X^{11}- \quad (23d)$$

wherein, $X^1$ can be selected from an amino acid comprising a large hydrophobic side chain;

$X^2$ can be selected from an amino acid comprising a large hydrophobic side chain;

$X^3$ can be selected from an amino acid comprising a small hydrophobic side chain and an amino acid comprising a large hydrophobic side chain;

$X^4$ can be selected from an amino acid comprising an acidic side chain, an amino acid comprising a hydroxyl side chain, and an amino acid comprising a large hydrophobic side chain;

$X^5$ can be selected from an amino acid comprising a large hydrophobic side chain;

$X^6$ can be selected from an amino acid comprising a small hydrophobic side chain, an amino acid comprising an acidic side chain, an amino acid comprising a polar/neutral side chain, and an amino acid comprising a basic side chain;

$X^7$ can be selected from an amino acid comprising a small hydrophobic side chain or an amino acid comprising a polar/neutral side chain;

$X^8$ can be selected from an amino acid comprising polar/neutral side chain and an amino acid comprising a large hydrophobic side chain;

$X^9$ can be selected from an amino acid comprising a basic side chain;

$X^{10}$ can be selected from an amino acid comprising a large hydrophobic side chain;

$X^{11}$ can be selected from an amino acid comprising a basic side chain;

$X^{12}$ can be selected from an amino acid comprising a small hydrophobic side chain; and $X^{13}$ can be selected from an amino acid comprising a polar/neutral side chain and an amino acid comprising a large hydrophobic side chain.

In IL-7Rα ligands of Formula (23)-(23d), $X^1$ can be can be L.

In IL-7Rα ligands of Formula (23)-(23d), $X^2$ can be selected from I, L, and V.

In IL-7Rα ligands of Formula (23)-(23d), $X^3$ can be selected from A, C, D, E, F, H, Q, and Y.

In IL-7Rα ligands of Formula (23)-(23d), $X^3$ can be selected from F, Q, and Y.

In IL-7Rα ligands of Formula (23)-(23d), $X^4$ can be selected from A, I, M, Q, T, and V.

In IL-7Rα ligands of Formula (23)-(23d), $X^5$ can be selected from D, E, F, H, I, N, S, T, V, and Y.

In IL-7Rα ligands of Formula (23)-(23d), $X^5$ can be selected from E, T, and V.

In IL-7Rα ligands of Formula (23)-(23d), $X^6$ can be selected from F, I, L, and W.

In IL-7Rα ligands of Formula (23)-(23d), $X^6$ can be selected from F and I.

In IL-7Rα ligands of Formula (23)-(23d), $X^7$ can be selected from A, D, E, G, H, K, L, R, and S.

In IL-7Rα ligands of Formula (23)-(23d), $X^7$ can be selected from G, H, and P.

In IL-7Rα ligands of Formula (23)-(23d), $X^8$ can be selected from A, E, G, N, P, Q, S, T, and V.

In IL-7Rα ligands of Formula (23)-(23d), $X^8$ can be selected from G and N.

In IL-7Rα ligands of Formula (23)-(23d), $X^9$ can be selected from F, G, I, Q, T, V, and Y.

In IL-7Rα ligands of Formula (23)-(23d), $X^9$ can be selected from G, Q, and Y.

In IL-7Rα ligands of Formula (23)-(23d), $X^{10}$ can be selected from K and R.

In IL-7Rα ligands of Formula (23)-(23d), $X^{11}$ can be selected from I, L, and V.

In IL-7Rα ligands of Formula (23)-(23d), $X^{11}$ can be selected from L and V.

In IL-7Rα ligands of Formula (23)-(23d), $X^{12}$ can be R.

In IL-7Rα ligands of Formula (23)-(23d), $X^{13}$ can be selected from A, G, L, Q, S, and T.

In IL-7Rα ligands of Formula (23)-(23d), $X^{13}$ can be selected from A, S, and T.

In IL-7Rα ligands of Formula (23)-(23d), the IL-7Rα ligand can be defined by any combination of $X^1$-$X^{11}$ as defined in the immediately preceding twenty one (21) paragraphs.

In IL-7Rα ligands of Formula (23)-(23d),
$X^1$ can be L;
$X^2$ can be selected from I, L, and V;
$X^3$ can be selected from A, C, D, E, F, H, Q, and Y;
$X^3$ can be selected from F, Q, and Y;
$X^4$ can be selected from A, I, M, Q, T, and V;
$X^5$ can be selected from D, E, F, H, I, N, S, T, V, and Y;
$X^5$ can be selected from E, T, and V;
$X^6$ can be selected from F, I, L, and W;
$X^6$ can be selected from F and I;
$X^7$ can be selected from A, D, E, G, H, K, L, P, R, and S;
$X^7$ can be selected from G, H, and P;
$X^8$ can be selected from A, E, G, N, P, Q, S, T, and V;
$X^8$ can be selected from G and N;
$X^9$ can be selected from F, G, I, Q, T, V, and Y;
$X^9$ can be selected from G, Q, and Y;
$X^{10}$ can be selected from K and R;
$X^{11}$ can be selected from I, L, and V;
$X^{11}$ can be selected from L and V;
$X^{12}$ can be R;
$X^{13}$ can be selected from A, G, L, Q, S, and T; and
$X^{13}$ can be selected from A, S, and T.

In IL-7Rα ligands of Formula (23)-(23d),
$X^1$ can be L;
$X^2$ can be selected from I, L, and V;
$X^3$ can be selected from F, Q, and Y;
$X^4$ can be selected from A, I, M, Q, T, and V;
$X^5$ can be selected from E, T, and V;
$X^6$ can be selected from F and I;
$X^7$ can be selected from G, H, and P;
$X^8$ can be selected from G and N;
$X^9$ can be selected from G, Q, and Y;
$X^{10}$ can be selected from K and R;
$X^{11}$ can be selected from L and V;
$X^{12}$ can be R; and
$X^{13}$ can be selected from A, S, and T.

In IL-7Rα ligands of Formula (23)-(23d),
$X^1$ can be L;
$X^2$ can be selected from an amino acid comprising a large hydrophobic side chain;
$X^3$ can be Y;
$X^4$ can be selected from an amino acid comprising a large hydrophobic side chain;
$X^5$ can be selected from an amino acid comprising a large hydrophobic side chain;
$X^6$ can be F;
$X^7$ can be H;
$X^8$ can be G;
$X^9$ can be Y;
$X^{10}$ can be K;
$X^{11}$ can be V;
$X^{12}$ can be R; and
$X^{13}$ can be S.

An IL-7Rα ligand can comprise the amino acid sequence of any one of SEQ ID NOS: 2027-2049:

```
F W C E V F A G I K V C R P    SEQ ID NO: 2027

I F C A I F H G V K V C R S    SEQ ID NO: 2028

I Y C Q I F D T V K I C R S    SEQ ID NO: 2029

I Y C M E F L S G R V C R G    SEQ ID NO: 2030

I A C A N F H G T R V C R T    SEQ ID NO: 2031

I Y C A F L S G Y K T C R S    SEQ ID NO: 2032

I D C F D F G F T K V C R P    SEQ ID NO: 2033

I Y C A Y L H G Y K V C R K    SEQ ID NO: 2034

I Y C I S I S N H K V C R A    SEQ ID NO: 2035

L Y C M V F P A G K V C R S    SEQ ID NO: 2036

L Q C V V I R N Q K L C R G    SEQ ID NO: 2037

L E C V T I K G Y K L C R L    SEQ ID NO: 2038

L D C I Y F G Q I K V C R A    SEQ ID NO: 2039

L Y C A E L H G F R V C R L    SEQ ID NO: 2040

L Q C T V I N S F K L C R L    SEQ ID NO: 2041

L Y C I E S Y N L R S C R I    SEQ ID NO: 2042

V Y C A E I G E Y R V C R Q    SEQ ID NO: 2043

V Q C V F I A P Y K L C R S    SEQ ID NO: 2044

V H C M S F E G Q R V C R A    SEQ ID NO: 2045
```

-continued

```
                                          SEQ ID NO: 2046
V F C I D F P V Y R V C R A

SEQ ID NO: 2047
V F C T T I H G Q K L C R A

SEQ ID NO: 2048
V V C A Y F W D Q K V C R E

SEQ ID NO: 2049
V Y C A K F D E V K V C R A
```

An IL-7Rα ligand provided by the present disclosure can comprise a truncated amino acid sequence of any one of SEQ ID NOS: 2022-2049.

An IL-7Rα ligand provided by the present disclosure can comprise an amino acid sequence selected from any one of SEQ ID NOS: 2022-2049, or a truncated amino acid sequence of any one of SEQ ID NOS: 2022-2049, wherein the amino acid sequence can independently comprise from 1 to 4 glycines (G) (SEQ ID NO: 9615) on the N-terminus, on the C-terminus, or on both the N- and C-termini.

An IL-7Rα ligand provided by the present disclosure can comprise an amino acid sequence selected from any one of SEQ ID NOS: 2022-2049, or a truncated amino acid sequence of any one of SEQ ID NOS: 2022-2049, wherein the amino acid sequence comprises one or more amino acid substitutions such as from 1 to 5 amino acid substitutions. The amino acid substitutions can comprise conservative amino acid substitutions.

An IL-7Rα ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2022-2049 or a truncated amino acid sequence of any one of SEQ ID NOS: 2022-2049.

An IL-7Rα ligand of any one of SEQ ID NOS: 2022-2049 can bind to the hIL-7Rα subunit with an $IC_{50}$ of less than 10 µM as determined using phage ELISA competition assays.

An IL-7Rα ligand of anyone of SEQ ID NOS: 2022-2049, a truncated IL-7Rα ligand of anyone of SEQ ID NOS: 2022-2049, or a substituted IL-7Rα ligand of any one of SEQ ID NOS: 2022-2049 can bind to the hIL-7Rα subunit with an $IC_{50}$ of less than 100 µM or less than 10 µM as determined using phage ELISA competition assays.

An IL-7Rα ligand of any one of SEQ ID NOS: 2027-2049 bind to the hIL-7Rα subunit with an $IC_{50}$ of less than 100 µM.

An IL-7Rα ligand can comprise an amino acid sequence of any one of SEQ ID NOS: 2050-2073, which are referred to as Family 3B IL-7Rα ligands.

An IL-7Rα ligand can comprise the amino acid sequence of Formula (24) (SEQ ID NO: 2050), an amino acid sequence of Formula (24a) (SEQ ID NO: 2051), an amino acid sequence of Formula (24b) (SEQ ID NO: 2052), an amino acid sequence of Formula (24c) (SEQ ID NO: 2053), an amino acid sequence of Formula (24d) (SEQ ID NO: 2054), or an amino acid sequence of Formula (24e) (SEQ ID NO: 2055):

$$-X^1-X^2-X^3-X^4-C-X^5-X^6-X^7-X^8-X^9-X^{10}-X^{11}-X^{12}-C-X^{13}-X^{14}-X^{15}- \quad (24)$$

$$-X^2-X^3-X^4-C-X^5-X^6-X^7-X^8-X^9-X^{10}-X^{11}-X^{12}-C-X^{13}-X^{14}-X^{15}- \quad (24a)$$

$$-X^3-X^4-C-X^5-X^6-X^7-X^8-X^9-X^{10}-X^{11}-X^{12}-C-X^{13}-X^{14}- \quad (24b)$$

$$-X^4-C-X^5-X^6-X^7-X^8-X^9-X^{10}-X^{11}-X^{12}-C-X^{13}- \quad (24c)$$

$$-C-X^5-X^6-X^7-X^8-X^9-X^{10}-X^{11}-X^{12}-C- \quad (24d)$$

$$-X^5-X^6-X^7-X^8-X^9-X^{10}-X^{11}-X^{12}- \quad (24e)$$

wherein, $X^1$ can be an amino acid comprising a large hydrophobic side chain;

$X^2$ can be selected from an amino acid comprising a small hydrophobic side chain and an amino acid comprising a polar/neutral side chain;

$X^3$ can be an amino acid comprising a large hydrophobic side chain;

$X^4$ can be an amino acid comprising a large hydrophobic side chain;

$X^5$ can be selected from an amino acid comprising a large hydrophobic side chain;

$X^6$ can be selected from an amino acid comprising a basic side chain and an amino acid comprising a polar/neutral side chain;

$X^7$ can be selected from an amino acid comprising a large hydrophobic side chain;

$X^8$ can be selected from an amino acid comprising a small hydrophobic side chain;

$X^9$ can be selected from an amino acid comprising a small hydrophobic side chain;

$X^{10}$ can be selected from an amino acid;

$X^{11}$ can be selected from an amino acid comprising a basic side chain and an amino acid comprising a large hydrophobic side chain;

$X^{12}$ can be selected from an amino acid comprising a large hydrophobic side chain;

$X^{13}$ can be selected from an amino acid comprising a basic side chain;

$X^{14}$ can be selected from an amino acid comprising a small hydrophobic side chain; and $X^{15}$ can be selected from an amino acid comprising a polar/neutral side chain.

In IL-7Rα ligands of Formula (24)-(24e), $X^1$ can be V.

In IL-7Rα ligands of Formula (24)-(24e), $X^2$ can be selected from G, H, N, P, Q, R, S, and V.

In IL-7Rα ligands of Formula (24)-(24e), $X^2$ can be P.

In IL-7Rα ligands of Formula (24)-(24e), $X^3$ can be selected from C, I, and V.

In IL-7Rα ligands of Formula (24)-(24e), $X^3$ can be V.

In IL-7Rα ligands of Formula (24)-(24e), $X^4$ can be selected from A, F, V, and Y.

In IL-7Rα ligands of Formula (24)-(24e), $X^4$ can be Y.

In IL-7Rα ligands of Formula (24)-(24e), $X^5$ can be selected from A, I, L, M, N, and V.

In IL-7Rα ligands of Formula (24)-(24e), $X^6$ can be selected from E, H, K, L, N, Q, R, and T.

In IL-7Rα ligands of Formula (24)-(24e), $X^7$ can be selected from F, G, L, and P.

In IL-7Rα ligands of Formula (24)-(24e), $X^7$ can be L.

In IL-7Rα ligands of Formula (24)-(24e), $X^8$ can be selected from G and P.

In IL-7Rα ligands of Formula (24)-(24e), $X^8$ can be P.

In IL-7Rα ligands of Formula (24)-(24e), $X^9$ can be selected from G and I.

In IL-7Rα ligands of Formula (24)-(24e), $X^9$ can be G.

In IL-7Rα ligands of Formula (24)-(24e), $X^{10}$ can be selected from G, H, Q, S, T, and Y.

In IL-7Rα ligands of Formula (24)-(24e), $X^{11}$ can be selected from K, R, V, and Y.

In IL-7Rα ligands of Formula (24)-(24e), $X^{12}$ can be selected from N, P, and V.

In IL-7Rα ligands of Formula (24)-(24e), $X^{12}$ can be V.
In IL-7Rα ligands of Formula (24)-(24e), $X^{13}$ can be R.
In IL-7Rα ligands of Formula (24)-(24e), $X^{14}$ can be selected from A, G, L, N, S, and V.
In IL-7Rα ligands of Formula (24)-(24e), $X^{14}$ can be S.
In IL-7Rα ligands of Formula (24)-(24e), $X^{15}$ can be selected from H, L, R, S, T, and Y.
In IL-7Rα ligands of Formula (24)-(24e), the IL-7Rα ligand can be defined by any combination of $X^1$-$X^{15}$ as defined in the immediately preceding twenty three (23) paragraphs.

In IL-7Rα ligands of Formula (24)-(24e),
$X^1$ can be V;
$X^2$ can be selected from G, H, N, P, Q, R, S, and V;
$X^3$ can be selected from C, I, and V;
$X^4$ can be selected from A, F, V, and Y;
$X^5$ can be selected from A, I, L, M, N, and V;
$X^6$ can be selected from E, H, K, L, N, Q, R, and T;
$X^7$ can be selected from F, G, L, and P;
$X^8$ can be selected from G and P;
$X^9$ can be selected from G and I;
$X^{10}$ can be selected from G, H, Q, S, T, and Y;
$X^{11}$ can be selected from K, R, V, and Y;
$X^{12}$ can be selected from N, P, and V;
$X^{13}$ can be R;
$X^{14}$ can be selected from A, G, L, N, S, and V; and
$X^{15}$ can be selected from H, L, R, S, T, and Y.

In IL-7Rα ligands of Formula (24)-(24e),
$X^1$ can be V;
$X^2$ can be P;
$X^3$ can be V;
$X^4$ can be Y;
$X^5$ can be selected from A, I, L, M, N, and V;
$X^6$ can be selected from E, H, K, L, N, Q, R, and T;
$X^7$ can be L;
$X^8$ can be P;
$X^9$ can be G;
$X^{10}$ can be selected from G, H, Q, S, T, and Y;
$X^{11}$ can be selected from K, R, V, and Y;
$X^{12}$ can be selected from N, P, and V;
$X^{12}$ can be V;
$X^{13}$ can be R;
$X^{14}$ can be S; and
$X^{15}$ can be selected from H, L, R, S, T, and Y.

In IL-7Rα ligands of Formula (24)-(24e),
$X^1$ can be V;
$X^2$ can be P;
$X^3$ can be V;
$X^4$ can be Y;
$X^5$ can be selected from an amino acid comprising a large hydrophobic side chain;
$X^6$ can be selected from an amino acid;
$X^7$ can be L;
$X^8$ can be P;
$X^9$ can be G;
$X^{10}$ can be selected from an amino acid;
$X^{11}$ can be selected from an amino acid comprising a basic side chain;
$X^{12}$ can be V;
$X^{13}$ can be R;
$X^{14}$ can be S; and
$X^{15}$ can be selected from an amino acid comprising a hydroxyl-containing side chain.

An IL-7Rα ligand can comprise the amino acid sequence of any one of SEQ ID NOS: 2056-2073:

```
                                       SEQ ID NO: 2056
     G V Y C L L G P G T V P C R A L

SEQ ID NO: 2057
     H V Y C L H G P G S V P C R S H

SEQ ID NO: 2058
     H V Y C L H G P G S V P C R S H

SEQ ID NO: 2059
     L V F C E M F P G G R V C R G E

SEQ ID NO: 2060
     N I A C M R F P G G Y V C R N Y

SEQ ID NO: 2061
     N I A C M R F P G G Y V C R N Y

SEQ ID NO: 2062
     P V Y C M E L P G H R V C R G S

SEQ ID NO: 2063
     P I Y C A K L P G G Y N C R

SEQ ID NO: 2064
     P V V C A T L P G G Y V C R V T

SEQ ID NO: 2065
     P V Y C M E L P G H R V C R G S

SEQ ID NO: 2066
     Q V Y C Q V F P G F K A C R T R

SEQ ID NO: 2067
     R V F C I N L P G Q R V C R L S

SEQ ID NO: 2068
     R I F C V T L P G G K S C R T F

SEQ ID NO: 2069
     R I Y C M V L P G G Y N C R A N

SEQ ID NO: 2070
     S V F C V Q F P G Y K V C R S S

SEQ ID NO: 2071
     T I A C V N L P G G Y V C R E Y

SEQ ID NO: 2072
     V V Y C I Q F P G Y K V C R S R

SEQ ID NO: 2073
     V Q C V T N L P G I Q K V C R S
```

An IL-7Rα ligand provided by the present disclosure can comprise a truncated amino acid sequence of any one of SEQ ID NOS: 2050-2073.

An IL-7Rα ligand provided by the present disclosure can comprise an amino acid sequence selected from any one of SEQ ID NOS: 2050-2073, or a truncated amino acid sequence of any one of SEQ ID NOS: 2050-2073, wherein the amino acid sequence can independently comprise from 1 to 4 glycines (G) (SEQ ID NO: 9615) on the N-terminus, on the C-terminus, or on both the N- and C-termini.

An IL-7Rα ligand provided by the present disclosure can comprise an amino acid sequence selected from any one of SEQ ID NOS: 2050-2073, or a truncated amino acid sequence of any one of SEQ ID NOS: 2050-2073, wherein the amino acid sequence comprises one or more amino acid substitutions such as from 1 to 5 amino acid substitutions. The amino acid substitutions can comprise conservative amino acid substitutions.

An IL-7Rα ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2050-2073 or a truncated amino acid sequence of any one of SEQ ID NOS: 2050-2073.

An IL-7Rα ligand of any one of SEQ ID NOS: 2050-2073 can bind to the hIL-7Rα subunit with an $IC_{50}$ of less than 10 μM as determined using phage ELISA competition assays.

An IL-7Rα ligand of any one of SEQ ID NOS: 2050-2073, a truncated IL-7Rα ligand of any one of SEQ ID NOS: 2050-2073, or a substituted IL-7Rα ligand of any one of SEQ ID NOS: 2050-2073 can bind to the hIL-7Rα subunit with an $IC_{50}$ of less than 100 μM or less than 10 μM as determined using phage ELISA competition assays.

An IL-7Rα ligand of any one of SEQ ID NOS: 2056-2073 bind to the hIL-7Rα subunit with an $IC_{50}$ of less than 100 μM.

An IL-7Rα ligand can comprise an amino acid sequence of any one of SEQ ID NOS: 2074-2082, which are referred to as Family 4 IL-7Rα ligands.

An IL-7Rα ligand can comprise the amino acid sequence of Formula (25) (SEQ ID NO: 2074), an amino acid sequence of Formula (25a) (SEQ ID NO: 2075), an amino acid sequence of Formula (25b) (SEQ ID NO: 2076), or an amino acid sequence of Formula (25c) (SEQ ID NO: 2077):

$$-X^1-X^2-X^3-X^4-X^5-X^6-X^7-X^8-X^9-X^{10}-X^{11}-X^{12}-X^{13}-X^{14}-X^{15}- \quad (25)$$

$$-X^2-X^3-X^4-X^5-X^6-X^7-X^8-X^9-X^{10}-X^{11}-X^{12}-X^{13}-X^{14}- \quad (25a)$$

$$-X^3-X^4-X^5-X^6-X^7-X^8-X^9-X^{10}-X^{11}-X^{12}-X^{13}- \quad (25b)$$

$$-X^4-X^5-X^6-X^7-X^8-X^9-X^{10}-X^{11}-X^{12}- \quad (25c)$$

wherein,
$X^1$ can be selected from C, K, R, S, and V;
$X^2$ can be selected from C and S;
$X^3$ can be selected from K, L, R, and S;
$X^4$ can be selected from G, H, R, S, and T;
$X^5$ can be selected from G, R, T, V, and W;
$X^6$ can be selected from D, F, P, and R;
$X^7$ can be selected from L, M, and W;
$X^8$ can be selected from D, E, and V;
$X^9$ can be selected from L, N, P, and S;
$X^{10}$ can be selected from D, F, L, and W;
$X^{11}$ can be selected from L, N, and W;
$X^{12}$ can be selected from G, I, L, and Q;
$X^{13}$ can be selected from C, F, N, and S;
$X^{14}$ can be selected from C, I and R; and
$X^{14}$ can be selected from L and N.

An IL-7Rα ligand can comprise the amino acid sequence of any one of SEQ ID NOS: 2078-2082:

```
                              SEQ ID NO: 2078
         C S R R V P W V L D N I F C

SEQ ID NO: 2079
         K C S S R R L D L W W L N C N

SEQ ID NO: 2080
         R C K G G F M V P F L G S C L

SEQ ID NO: 2081
         S C L H W D L E S L L Q C I

SEQ ID NO: 2082
         V C R T T R L D N W W G C R
```

An IL-7Rα ligand provided by the present disclosure can comprise a truncated amino acid sequence of any one of SEQ ID NOS: 2074-2082.

An IL-7Rα ligand provided by the present disclosure can comprise an amino acid sequence selected from any one of SEQ ID NOS: 2074-2082, or a truncated amino acid sequence of any one of SEQ ID NOS: 2074-2082, wherein the amino acid sequence can independently comprise from 1 to 4 glycines (G) (SEQ ID NO: 9615) on the N-terminus, on the C-terminus, or on both the N- and C-termini.

An IL-7Rα ligand provided by the present disclosure can comprise an amino acid sequence selected from any one of SEQ ID NOS: 2074-2082, or a truncated amino acid sequence of any one of SEQ ID NOS: 2074-2082, wherein the amino acid sequence comprises one or more amino acid substitutions such as from 1 to 5 amino acid substitutions. The amino acid substitutions can comprise conservative amino acid substitutions.

An IL-7Rα ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2074-2082 or a truncated amino acid sequence of any one of SEQ ID NOS: 2074-2082.

An IL-7Rα ligand of any one of SEQ ID NOS: 2074-2082 can bind to the hIL-7Rα subunit with an $IC_{50}$ of less than 10 μM as determined using phage ELISA competition assays.

An IL-7Rα ligand of any one of SEQ ID NOS: 2074-2082, a truncated IL-7Rα ligand of any one of SEQ ID NOS: 2074-2082, or a substituted IL-7Rα ligand of any one of SEQ ID NOS: 2074-2082 can bind to the hIL-7Rα subunit with an $IC_{50}$ of less than 100 μM or less than 10 μM as determined using phage ELISA competition assays.

An IL-7Rα ligand of any one of SEQ ID NOS: 2078-2082 bind to the hIL-7Rα subunit with an $IC_{50}$ of less than 100 μM.

An IL-7Rα ligand can comprise an amino acid sequence selected from anyone of SEQ ID NOS: 2083-2105:

```
                              SEQ ID NO: 2083
         A N R V H V Q Q G F W W

SEQ ID NO: 2084
         F V F C G Q D Y Q M C K N F

SEQ ID NO: 2085
         G D S Q V A Y W S P Y A

SEQ ID NO: 2086
         H C R L Q K P G F H R S S C Y

SEQ ID NO: 2087
         H C R L Q K P G F H R S S C

SEQ ID NO: 2088
         I S C Y F P A G L K P L C R Y

SEQ ID NO: 2089
         K E A G G P P G G E G G R

SEQ ID NO: 2090
         K L C R G G W V W L D W C V N

SEQ ID NO: 2091
         L V C W T H W S N Q R L C R T

SEQ ID NO: 2092
         L H C W E H W L G T K I C R L
```

-continued

LVFCEMFPGGRVCRGE  SEQ ID NO: 2093

NVFCVYFDSKVCRTR  SEQ ID NO: 2094

NVFCVYFDSKVCRT  SEQ ID NO: 2095

QNCYELRDAALMCAM  SEQ ID NO: 2096

QVCCIHFPGRMVCRAC  SEQ ID NO: 2097

SRDVRELIVIAS  SEQ ID NO: 2098

TVLSFEAWQILF  SEQ ID NO: 2099

VCCVDLNSVKICRRC  SEQ ID NO: 2100

WRICCINPGLRVCRQC  SEQ ID NO: 2101

YRQLCLDALLSI  SEQ ID NO: 2102

YWACSSGMNLCRWN  SEQ ID NO: 2103

YMACSSGLSLCRLS  SEQ ID NO: 2104

YLACSTTLGKCRWN  SEQ ID NO: 2105

An IL-7Rα ligand provided by the present disclosure can comprise a truncated amino acid sequence of any one of SEQ ID NOS: 2083-2105.

An IL-7Rα ligand provided by the present disclosure can comprise an amino acid sequence selected from any one of SEQ ID NOS: 2083-2105, or a truncated amino acid sequence of any one of SEQ ID NOS: 2083-2105, wherein the amino acid sequence can independently comprise from 1 to 4 glycines (G) on the N-terminus, on the C-terminus, or on both the N- and C-termini.

An IL-7Rα ligand provided by the present disclosure can comprise an amino acid sequence selected from any one of SEQ ID NOS: 2083-2105, or a truncated amino acid sequence of any one of SEQ ID NOS: 2083-2105, wherein the amino acid sequence comprises one or more amino acid substitutions such as from 1 to 5 amino acid substitutions. The amino acid substitutions can comprise conservative amino acid substitutions.

An IL-7Rα ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2083-2105 or a truncated amino acid sequence of any one of SEQ ID NOS: 2083-2105.

An IL-7Rα ligand of any one of SEQ ID NOS: 2083-2105 can bind to the hIL-7Rα subunit with an $IC_{50}$ of less than 10 μM as determined using phage ELISA competition assays.

An IL-7Rα ligand of any one of SEQ ID NOS: 2083-2105, a truncated IL-7Rα ligand of any one of SEQ ID NOS: 2083-2105, or a substituted IL-7Rα ligand of any one of SEQ ID NOS: 2083-2105 can bind to the hIL-7Rα subunit with an $IC_{50}$ of less than 100 μM or less than 10 μM as determined using phage ELISA competition assays.

An IL-7Rα ligand of any one of SEQ ID NOS: 2083-2105 bind to the hIL-7Rα subunit with an $IC_{50}$ of less than 100 μM.

An IL-7Rα ligand can comprise an amino acid sequence of any one of SEQ ID NOS: 2106-2183, which are included in the Family 1 IL-7Rα ligands.

An IL-7Rα ligand can comprise the amino acid sequence of Formula (26) (SEQ ID NO: 2106), an amino acid sequence of Formula (26a) (SEQ ID NO: 2107), an amino acid sequence of Formula (26b) (SEQ ID NO: 2108), an amino acid sequence of Formula (26c) (SEQ ID NO: 2109), an amino acid sequence of Formula (26d) (SEQ ID NO: 2110), an amino acid sequence of Formula (26e) (SEQ ID NO: 2111):

$$-X^1-X^2-X^3-X^4-X^5-X^6-X^7-C-X^8-X^9-X^{10}-X^{11}-X^{12}-X^{13}-X^{14}-X^{15}-X^{16}-X^{17}-C-X^{18}-X^{19}-X^{20}-X^{21}-X^{22}-X^{23}-X^{24}-X^{25}-X^{26}- \quad (26)$$

$$-X^5-X^6-X^7-C-X^8-X^9-X^{10}-X^{11}-X^{12}-X^{13}-X^{14}-X^{15}-X^{16}-X^{17}-C-X^{18}-X^{19}-X^{20}- \quad (26a)$$

$$-X^6-X^7-C-X^8-X^9-X^{10}-X^{11}-X^{12}-X^{13}-X^{14}-X^{15}-X^{16}-X^{17}-C-X^{18}-X^{19}- \quad (26b)$$

$$-X^7-C-X^8-X^9-X^{10}-X^{11}-X^{12}-X^{13}-X^{14}-X^{15}-X^{16}-X^{17}-C-X^{18}- \quad (26c)$$

$$-C-X^8-X^9-X^{10}-X^{11}-X^{12}-X^{13}-X^{14}-X^{15}-X^{16}-X^{17}-C- \quad (26d)$$

$$-X^8-X^9-X^{10}-X^{11}-X^{12}-X^{13}-X^{14}-X^{15}-X^{16}-X^{17}- \quad (26e)$$

wherein, $X^1$ can be selected from an amino acid comprising a small hydrophobic side chain;

$X^2$ can be selected from an amino acid;

$X^3$ can be selected from an amino acid comprising a polar/neutral side chain;

$X^4$ can be selected from an amino acid comprising a polar neutral side chain and an amino acid comprising a basic side chain;

$X^5$ can be selected from an amino acid comprising a small hydrophobic side chain;

$X^6$ can be selected from an amino acid comprising a small hydrophobic side chain;

$X^7$ can be selected from an amino acid comprising a polar/neutral hydrophobic side chain, and amino acid comprising an acidic side chain, and an amino acid comprising an aromatic side chain;

$X^8$ can be selected from an amino acid comprising a large hydrophobic side chain;

$X^9$ can be selected from an amino acid comprising a basic side chain;

$X^{10}$ can be selected from an amino acid comprising a large hydrophobic side chain;

$X^{11}$ can be selected from an amino acid comprising an acidic side chain;

$X^{12}$ can be selected from an amino acid comprising a large hydrophobic side chain;

$X^{13}$ can be selected from an amino acid comprising an acidic side chain;

$X^{14}$ can be selected from an amino acid comprising a hydroxyl-containing side chain;

$X^{15}$ can be selected from an amino acid comprising a large hydrophobic side chain;

$X^{16}$ can be selected from an amino acid comprising a large hydrophobic side chain;

$X^{17}$ can be selected from an amino acid comprising a small hydrophobic side chain;

$X^{18}$ can be selected from an amino acid comprising a large hydrophobic side chain;

$X^{19}$ can be selected from an amino acid comprising an acidic side chain, an amino acid comprising a polar/neutral side chain, and an amino acid comprising a basic side chain;

$X^{20}$ can be selected from an amino acid;

$X^{21}$ can be selected from an amino acid;

$X^{22}$ can be selected from an amino acid;

$X^{23}$ can be selected from an amino acid;

$X^{24}$ can be selected from an amino acid;

$X^{25}$ can be selected from an amino acid; and $X^{26}$ can be selected from an amino acid.

In IL-7Rα ligands of Formula (26)-(26e), X can be selected from E, G, I, Q, R, S, and T.

In IL-7Rα ligands of Formula (26)-(26e), $X^2$ can be selected from A, D, G, H, M, R, S, V, and W.

In IL-7Rα ligands of Formula (26)-(26e), $X^3$ can be selected from F, G, K, L, Q, S, and Y.

In IL-7Rα ligands of Formula (26)-(26e), $X^4$ can be selected from I, K, M, N, P, Q, R, S, T, and V.

In IL-7Rα ligands of Formula (26)-(26e), $X^5$ can be selected from F, G, K, L, M, Q, R, S, T, and W.

In IL-7Rα ligands of Formula (26)-(26e), $X^5$ can be G.

In IL-7Rα ligands of Formula (26)-(26e), $X^6$ can be selected from A, D, E, F, G, I, K, L, M, R, S, T, and Y.

In IL-7Rα ligands of Formula (26)-(26e), $X^6$ can be G.

In IL-7Rα ligands of Formula (26)-(26e), $X^7$ can be selected from D, E, F, G, H, N, P, Q, R, and Y.

In IL-7Rα ligands of Formula (26)-(26e), $X^7$ can be selected from H, Q, and Y.

In IL-7Rα ligands of Formula (26)-(26e), X can be selected from A, F, I, K, L, M, N, P, S, T, V, and Y.

In IL-7Rα ligands of Formula (26)-(26e), $X^9$ can be selected from G, H, K, and S.

In IL-7Rα ligands of Formula (26)-(26e), $X^9$ can be H.

In IL-7Rα ligands of Formula (26)-(26e), $X^{10}$ can be selected from F, I, K, L, S, and W.

In IL-7Rα ligands of Formula (26)-(26e), $X^{10}$ can be W.

In IL-7Rα ligands of Formula (26)-(26e), $X^{11}$ can be selected from D, E, and P.

In IL-7Rα ligands of Formula (26)-(26e), $X^{11}$ can be D.

In IL-7Rα ligands of Formula (26)-(26e), $X^{12}$ can be selected from I, F, L, and M.

In IL-7Rα ligands of Formula (26)-(26e), $X^{12}$ can be L.

In IL-7Rα ligands of Formula (26)-(26e), $X^{13}$ can be selected from D, E, G, Q, T, and Y.

In IL-7Rα ligands of Formula (26)-(26e), $X^{13}$ can be E.

In IL-7Rα ligands of Formula (26)-(26e), $X^{14}$ can be selected from Q, S, and T.

In IL-7Rα ligands of Formula (26)-(26e), $X^{14}$ can be S.

In IL-7Rα ligands of Formula (26)-(26e), $X^{15}$ can be selected from L, F, and S.

In IL-7Rα ligands of Formula (26)-(26e), $X^{15}$ can be L.

In IL-7Rα ligands of Formula (26)-(26e), $X^{16}$ can be selected from F, I, L, M, N, V, and W.

In IL-7Rα ligands of Formula (26)-(26e), $X^{16}$ can be L.

In IL-7Rα ligands of Formula (26)-(26e), $X^{17}$ can be selected from A, D, E, F, G, H, L, M, N, Q, R, S, W, and Y.

In IL-7Rα ligands of Formula (26)-(26e), $X^{17}$ can be selected from A and S.

In IL-7Rα ligands of Formula (26)-(26e), $X^{18}$ can be selected from F, I, K, L, M, Q, R, and V.

In IL-7Rα ligands of Formula (26)-(26e), $X^{18}$ can be V.

In IL-7Rα ligands of Formula (26)-(26e), $X^{19}$ can be selected from A, D, E, G, H, K, M, N, Q, R, S, and Y.

In IL-7Rα ligands of Formula (26)-(26e), $X^{19}$ can be R.

In IL-7Rα ligands of Formula (26)-(26e), $X^{20}$ can be selected from A, D, E, G, I, K, M, N, P, Q, R, S, T, and Y.

In IL-7Rα ligands of Formula (26)-(26e), $X^{21}$ can be selected from A, E, G, H, I, K, L, N, P, Q, R, S, and W.

In IL-7Rα ligands of Formula (26)-(26e), $X^{22}$ can be selected from A, E, F, I, K, L, P, R, S, and T.

In IL-7Rα ligands of Formula (26)-(26e), $X^{23}$ can be selected from D, E, F, G, I, L, M, N, R, W, and Y.

In IL-7Rα ligands of Formula (26)-(26e), $X^{24}$ can be selected from A, E, G, H, K, L, P, Q, R, S, T, and Y.

In IL-7Rα ligands of Formula (26)-(26e), $X^{25}$ can be E.

In IL-7Rα ligands of Formula (26)-(26e), $X^{26}$ can be A.

In IL-7Rα ligands of Formula (26)-(26e), the IL-7Rα ligand can be defined by any combination of $X^1$-$X^{26}$ as defined in the immediately preceding forty (40) paragraphs.

In IL-7Rα ligands of Formula (26)-(26e), $X^1$ can be selected from E, G, I, Q, R, S, and T;

$X^2$ can be selected from A, D, G, H, M, R, S, V, and W;

$X^3$ can be selected from F, G, K, L, Q, S, and Y;

$X^4$ can be selected from I, K, M, N, P, Q, R, S, T, and V;

$X^5$ can be selected from F, G, K, L, M, Q, R, S, T, and W;

$X^6$ can be selected from A, D, E, F, G, I, K, L, M, R, S, T, and Y;

$X^7$ can be selected from D, E, F, G, H, N, P, Q, R, and Y;

$X^8$ can be selected from A, F, I, K, L, M, N, P, S, T, V, and Y;

$X^9$ can be selected from G, H, K, and S;

$X^{10}$ can be selected from F, I, K, L, S, and W;

$X^{11}$ can be selected from D, E, and P;

$X^{12}$ can be selected from I, F, L, and M;

$X^{13}$ can be selected from D, E, G, Q, T, and Y;

$X^{14}$ can be selected from Q, S, and T;

$X^{15}$ can be selected from F, L, and S;

$X^{16}$ can be selected from F, I, L, M, N, V, and W;

$X^{17}$ can be selected from A, D, E, F, G, H, L, M, N, Q, R, S, W, and Y;

$X^{18}$ can be selected from F, I, K, L, M, Q, R, and V;

$X^{19}$ can be selected from A, D, E, G, H, K, M, N, Q, R, S, and Y;

$X^{20}$ can be selected from A, D, E, G, I, K, M, N, P, Q, R, S, T, and Y;

$X^{21}$ can be selected from A, E, G, H, I, K, L, N, P, Q, R, S, and W;

$X^{22}$ can be selected from A, E, F, I, K, L, P, R, S, and T;

$X^{23}$ can be selected from D, E, F, G, I, L, M, N, R, W, and Y;

$X^{24}$ can be selected from A, E, G, H, K, L, P, Q, R, S, T, and Y;

$X^{25}$ can be E; and $X^{26}$ can be A.

In IL-7Rα ligands of Formula (26)-(26e), $X^1$ can be selected from E, G, I, Q, R, S, and T;

$X^2$ can be selected from A, D, G, H, M, R, S, V, and W;

$X^3$ can be selected from F, G, K, L, Q, S, and Y;

$X^4$ can be selected from I, K, M, N, P, Q, R, S, T, and V;

$X^5$ can be G;

$X^6$ can be G;

$X^7$ can be selected from H, Q, and Y;

$X^8$ can be selected from A, F, I, K, L, M, N, P, S, T, V, and Y;

$X^9$ can be H;

$X^{10}$ can be W;

$X^{11}$ can be D;

$X^{12}$ can be L;

$X^{13}$ can be E;

$X^{14}$ can be S;

$X^{15}$ can be L;

$X^{16}$ can be L;
$X^{17}$ can be selected from A and S;
$X^{18}$ can be V;
$X^{19}$ can be R;
$X^{20}$ can be selected from A, D, E, G, I, K, M, N, P, Q, R, S, T, and Y;
$X^{21}$ can be selected from A, E, G, H, I, K, L, N, P, Q, R, S, and W;
$X^{22}$ can be selected from A, E, F, I, K, L, P, R, S, and T;
$X^{23}$ can be selected from D, E, F, G, I, L, M, N, R, W, and Y;
$X^{24}$ can be selected from A, E, G, H, K, L, P, Q, R, S, T, and Y;
$X^{25}$ can be E; and
$X^{26}$ can be A.

In IL-7Rα ligands of Formula (26)-(26e),
$X^7$ can be selected from an amino acid comprising a large hydrophobic side chain;
$X^8$ can be selected from an amino acid comprising a basic side chain;
$X^9$ can be selected from H and K;
$X^{10}$ can be W;
$X^{11}$ can be D;
$X^{12}$ can be selected from I, L, and M;
$X^{13}$ can be selected from D and E;
$X^{14}$ can be selected from S and T;
$X^{15}$ can be selected from F and L;
$X^{16}$ can be selected from F, L, and M;
$X^{17}$ can be selected from A and S; and
$X^{18}$ can be selected from I and V.

In IL-7Rα ligands of Formula (26)-(26e),
$X^7$ can be selected from H, Q and Y;
$X^8$ can be selected from A, F, I, K, L, M, N, P, S, T, V, and Y;
$X^9$ can be selected from H and K;
$X^{10}$ can be W;
$X^{11}$ can be D;
$X^{12}$ can be selected from I, L, and M;
$X^{13}$ can be selected from D and E;
$X^{14}$ can be selected from S and T;
$X^{15}$ can be selected from F and L;
$X^{16}$ can be selected from F, L, and M;
$X^{17}$ can be selected from A and S; and
$X^{18}$ can be selected from I and V.

In IL-7Rα ligands of Formula (26)-(26e),
$X^7$ can be selected from H, Q, and Y;
$X^8$ can be selected from A, F, I, K, L, M, N, P, S, T, V, and Y;
$X^9$ can be H;
$X^{10}$ can be W;
$X^{11}$ can be D;
$X^{12}$ can be L;
$X^{13}$ can be E;
$X^{14}$ can be S;
$X^{15}$ can be L;
$X^{16}$ can be L;
$X^{17}$ can be selected from A and S; and
$X^{18}$ can be V.

An IL-7Rα ligand can comprise an amino acid sequence selected from anyone of SEQ ID NOS: 2112-2183:

D S K Q E Q C F H W D L E S L L S C L  SEQ ID NO: 2112

D C M H W D L E S L L A C V  SEQ ID NO: 2113

D C I H W D L E S L L R C V  SEQ ID NO: 2114

D C Y H W D L E S L L A C L  SEQ ID NO: 2115

D C F H W D M E S L L R C V  SEQ ID NO: 2116

E C M H W D L E S L L A C V  SEQ ID NO: 2117

E D F Q G Y Q C F H W D I E S L L S C I  SEQ ID NO: 2118

E C I H W D L E S L L S C V  SEQ ID NO: 2119

F C M H W D M E S L L A C V Q G A A M Q  SEQ ID NO: 2120

H C L H W D I E T L M S C V Y G N F E E  SEQ ID NO: 2121

H C N H W D F E S L V S C V K D W S W S  SEQ ID NO: 2122

H C K H W D L E S L L L C V  SEQ ID NO: 2123

H C K H W D I E S L L S C V G I R L E P  SEQ ID NO: 2124

H C V H W D L E S L L S C V N M Q K L K  SEQ ID NO: 2125

H C I H W D L E S L L A C V Q M H K G S  SEQ ID NO: 2126

H C M H W D M E T L L E C V R Q W K I T  SEQ ID NO: 2127

H C I H W D L E S L L S C V E D R R D R  SEQ ID NO: 2128

H C V H W D L E S L L S C V N E P R F K  SEQ ID NO: 2129

H C N H W D L E S L L S C V R N G A E Q  SEQ ID NO: 2130

H C I H W D L D S L L A C V M G Q R N Q  SEQ ID NO: 2131

H C M H S D M Q T L F A C M R D H I Y A  SEQ ID NO: 2132

H C M H W D L E S L L A C V  SEQ ID NO: 2133

H C I H W D L E S L L A C V M G Q R N Q  SEQ ID NO: 2134

H C V H W D L E S L L D C V R R Q P L K  SEQ ID NO: 2135

H C N H W D L E S L L S C V  SEQ ID NO: 2136

H C F H W D L E S L L A C V  SEQ ID NO: 2137

H C I H W D M E S L I A C V  SEQ ID NO: 2138

H C V H W D L E S L L S C V  SEQ ID NO: 2139

H C I H W D L D S L L S C V  SEQ ID NO: 2140

IHSSWAQCMHWDLESLISCV SEQ ID NO: 2141

MGLQCTHWDFDSLMACKREL SEQ ID NO: 2142

NCLHWDLESLLSCVSDLREG SEQ ID NO: 2143

NMRHCLHWDMESLMACVNQW SEQ ID NO: 2144

NCMHWDIESLLQCVRQIRDY SEQ ID NO: 2145

QCVHWDLDTLFGCIREQLEL SEQ ID NO: 2146

QGSRFTECMHWDIESLLSCI SEQ ID NO: 2147

QCIHWDLESLLNCLRELKEP SEQ ID NO: 2148

QCVHWDITTLLSCVKNLLDE SEQ ID NO: 2149

QCFHWDFESLMSCV SEQ ID NO: 2150

QCLHWDLESLLACV SEQ ID NO: 2151

QCVHWDFESLLACV SEQ ID NO: 2152

QMFGCIHWDLETLLMCVEKL SEQ ID NO: 2153

QCIHWDLESLLSCVESERRL SEQ ID NO: 2154

QGMNCSHWDLETLLDCMRTL SEQ ID NO: 2155

QCIHWDIETLLSCV SEQ ID NO: 2156

QCFHWDLESLLSCL SEQ ID NO: 2157

QTMPCLHWDLESLLFCVKGL SEQ ID NO: 2158

QCIHWDIETLLSCV SEQ ID NO: 2159

QCLHWDLESLLACV SEQ ID NO: 2160

QCVHWDLESLLYCV SEQ ID NO: 2161

QCLHWDLESLLSCV SEQ ID NO: 2162

QCLHWDLESLLSCV SEQ ID NO: 2163

QCMHWDLESLLSCV SEQ ID NO: 2164

QCLHWDLETLLACV SEQ ID NO: 2165

RMYVRDQCISLDMDTFLSCL SEQ ID NO: 2166

RRIHCMKWEFDTLMWCRGPQ SEQ ID NO: 2167

RTRQCNHWDLESLLMCIQNL SEQ ID NO: 2168

RLIQSPCMHWDLESLLLCV SEQ ID NO: 2169

SAKVLKQCLHWDLESLLSCL SEQ ID NO: 2170

SRRQCVKKDLGTFWSCFKAP SEQ ID NO: 2171

SSSRLMQCMHWDLESLLQCV SEQ ID NO: 2172

TVQPSSHCFHWDIDSLLSCL SEQ ID NO: 2173

VRAQCMHWDLESLLSCVDRS SEQ ID NO: 2174

WGTKAYCNHWDLESLLACV SEQ ID NO: 2175

WGQCMHWDLESLLSCV SEQ ID NO: 2176

YCMHWDLESLLWCVHRKELE SEQ ID NO: 2177

YCPHFDIDSLLDCVRQSTWY SEQ ID NO: 2178

YCFHWDLESLISCV SEQ ID NO: 2179

YCAHWDLESLLSCVEGLSRS SEQ ID NO: 2180

YCIHWDLESLLSCVSYNERH SEQ ID NO: 2181

YCFHWDLETLMQCVAKGSNR SEQ ID NO: 2182

YCMHWDLETLLACV SEQ ID NO: 2183

An IL-7Rα ligand provided by the present disclosure can comprise a truncated amino acid sequence of any one of SEQ ID NOS: 2106-2183.

An IL-7Rα ligand provided by the present disclosure can comprise an amino acid sequence selected from any one of SEQ ID NOS: 2106-2183, or a truncated amino acid sequence of any one of SEQ ID NOS: 2106-2183, wherein the amino acid sequence can independently comprise from 1 to 4 glycines (G) (SEQ ID NO: 9615) on the N-terminus, on the C-terminus, or on both the N- and C-termini.

An IL-7Rα ligand provided by the present disclosure can comprise an amino acid sequence selected from any one of SEQ ID NOS: 2106-2183, or a truncated amino acid sequence of any one of SEQ ID NOS: 2106-2183, wherein the amino acid sequence comprises one or more amino acid substitutions such as from 1 to 5 amino acid substitutions. The amino acid substitutions can comprise conservative amino acid substitutions.

An IL-7Rα ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2106-2183 or a truncated amino acid sequence of any one of SEQ ID NOS: 2106-2183.

An IL-7Rα ligand of anyone of SEQ ID NOS: 2106-2183 can bind to the hIL-7Rα subunit with an $IC_{50}$ of less than 10 µM as determined using phage ELISA competition assays.

An IL-7Rα ligand of any one of SEQ ID NOS: 2106-2183, a truncated IL-7Rα ligand of any one of SEQ ID NOS: 2106-2183, or a substituted IL-7Rα ligand of any one of SEQ ID NOS: 2106-2183 can bind to the hIL-7Rα subunit with an $IC_{50}$ of less than 100 µM or less than 10 µM as determined using phage ELISA competition assays.

An IL-7Rα ligand of any one of SEQ ID NOS: 2112-2183 bind to the hIL-7Rα subunit with an $IC_{50}$ of less than 100 µM.

An IL-7Rα ligand can comprise an amino acid sequence of any one of SEQ ID NOS: 2184-2349, which are included in the Family 3A IL-7Rα ligands.

An IL-7Rα ligand can comprise the amino acid sequence of Formula (27) (SEQ ID NO: 2184), an amino acid sequence of Formula (27a) (SEQ ID NO: 2185), an amino acid sequence of Formula (27b) (SEQ ID NO: 2186), an amino acid sequence of Formula (27c) (SEQ ID NO: 2187), an amino acid sequence of Formula (27d) (SEQ ID NO: 2188), or an amino acid sequence of Formula (27e) (SEQ ID NO: 2189):

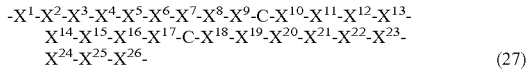  (27)

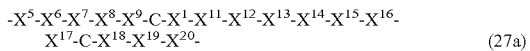  (27a)

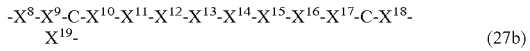  (27b)

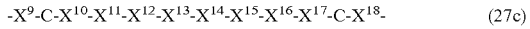  (27c)

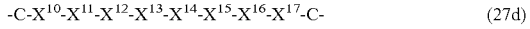  (27d)

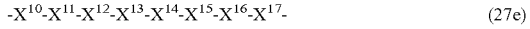  (27e)

wherein,
$X^1$ can be selected from an amino acid;
$X^2$ can be selected from an amino acid;
$X^3$ can be selected from an amino acid;
$X^4$ can be selected from an amino acid;
$X^5$ can be selected from an amino acid;
$X^6$ can be selected from an amino acid;
$X^7$ can be selected from an amino acid comprising a large hydrophobic side chain;
$X^8$ can be selected from an amino acid comprising a small hydrophobic side chain;
$X^9$ can be selected from an amino acid comprising a large hydrophobic side chain;
$X^{10}$ can be selected from an amino acid comprising a large hydrophobic side chain and an amino acid comprising a small hydrophobic side chain;
$X^{11}$ can be selected from an amino acid comprising a large hydrophobic side chain;
$X^{12}$ can be selected from an amino acid comprising an acidic side chain;
$X^{13}$ can be selected from an amino acid comprising a small hydrophobic side chain;
$X^{14}$ can be selected from an amino acid comprising a small hydrophobic side chain;
$X^{15}$ can be selected from an amino acid comprising a small hydrophobic side chain;
$X^{16}$ can be selected from an amino acid comprising a large hydrophobic side chain;
$X^{17}$ can be selected from an amino acid comprising a polar/neutral side chain;
$X^{18}$ can be selected from an amino acid comprising a small hydrophobic side chain;
$X^{19}$ can be selected from an amino acid comprising an aromatic side chain;
$X^{20}$ can be selected from an amino acid comprising a large hydrophobic side chain;
$X^{21}$ can be selected from an amino acid comprising a polar/neutral side chain;
$X^{22}$ can be selected from an amino acid comprising a polar/neutral side chain;
$X^{23}$ can be selected from an amino acid comprising an acidic side chain and an amino acid comprising a polar/neutral side chain;
$X^{24}$ can be selected from an amino acid;
$X^{25}$ can be selected from an amino acid; and
$X^{26}$ can be selected from an amino acid.

In IL-7Rα ligands of Formula (27)-(27e), $X^1$ can be selected from D, E, G, H, I, K, M, N, Q, R, S, T, V, W, and Y.

In IL-7Rα ligands of Formula (27)-(27e), $X^1$ can be G.

In IL-7Rα ligands of Formula (27)-(27e), $X^2$ can be selected from A, C, D, E, F, G, H, K, N, P, Q, R, S, T, V, and W.

In IL-7Rα ligands of Formula (27)-(27e), $X^3$ can be selected from E, F, G, H, I, K, L, M, N, Q, R, S, and W.

In IL-7Rα ligands of Formula (27)-(27e), $X^4$ can be selected from A, D, E, F, G, H, I, K, L, M, N, Q, R, S, T, V, W, and Y.

In IL-7Rα ligands of Formula (27)-(27e), $X^4$ can be selected from D, E, G, R, S, T, and W.

In IL-7Rα ligands of Formula (27)-(27e), $X^4$ can be G.

In IL-7Rα ligands of Formula (27)-(27e), $X^5$ can be selected from A, C, D, E, F, G, H, I, K, L, M, N, Q, R, S, T, V, and W.

In IL-7Rα ligands of Formula (27)-(27e), $X^5$ can be selected from G, R, S, and T.

In IL-7Rα ligands of Formula (27)-(27e), $X^6$ can be selected from A, D, E, F, G, H, I, K, L, M, P, Q, R, S, T, V, and Y.

In IL-7Rα ligands of Formula (27)-(27e), $X^6$ can be selected from G, R, S, T, and V.

In IL-7Rα ligands of Formula (27)-(27e), $X^6$ can be G.

In IL-7Rα ligands of Formula (27)-(27e), $X^7$ can be selected from D, I, L, and V.

In IL-7Rα ligands of Formula (27)-(27e), $X^7$ can be selected from I and V.

In IL-7Rα ligands of Formula (27)-(27e), $X^8$ can be selected from D, F, N, P, and R.

In IL-7Rα ligands of Formula (27)-(27e), $X^8$ can be P.

In IL-7Rα ligands of Formula (27)-(27e), $X^9$ can be selected from G, S, and W.

In IL-7Rα ligands of Formula (27)-(27e), $X^9$ can be W.

In IL-7Rα ligands of Formula (27)-(27e), $X^{10}$ can be selected from A, D, E, H, I, K, L, M, N, Q, R, S, T, and V.

In IL-7Rα ligands of Formula (27)-(27e), $X^{10}$ can be selected from L, M, S, and T.

In IL-7Rα ligands of Formula (27)-(27e), $X^{10}$ can be T.

In IL-7Rα ligands of Formula (27)-(27e), $X^{11}$ can be selected from D, L, and W.

In IL-7Rα ligands of Formula (27)-(27e), $X^{11}$ can be L.

In IL-7Rα ligands of Formula (27)-(27e), $X^{12}$ can be selected from A, D, H, Q, and W.

In IL-7Rα ligands of Formula (27)-(27e), $X^{12}$ can be D.

In IL-7Rα ligands of Formula (27)-(27e), $X^{13}$ can be P.

In IL-7Rα ligands of Formula (27)-(27e), $X^{14}$ can be G.

In IL-7Rα ligands of Formula (27)-(27e), $X^{15}$ can be selected from A, G, and S.

In IL-7Rα ligands of Formula (27)-(27e), $X^{15}$ can be S.

In IL-7Rα ligands of Formula (27)-(27e), $X^{16}$ can be selected from F, I, L, M, Q, V, and Y.

In IL-7Rα ligands of Formula (27)-(27e), $X^{16}$ can be L.

In IL-7Rα ligands of Formula (27)-(27e), $X^{17}$ can be selected from H, Q, and R.

In IL-7Rα ligands of Formula (27)-(27e), $X^{17}$ can be Q.

In IL-7Rα ligands of Formula (27)-(27e), $X^{18}$ can be selected from A, D, E, G, H, K, L, M, Q, S, T, V, and W.

In IL-7Rα ligands of Formula (27)-(27e), $X^{18}$ can be A.

In IL-7Rα ligands of Formula (27)-(27e), $X^{19}$ can be selected from F, R, W, and Y.

In IL-7Rα ligands of Formula (27)-(27e), $X^{19}$ can be W.

In IL-7Rα ligands of Formula (27)-(27e), $X^{20}$ can be selected from F, I, L, M, Q, S, V, W, and Y.

In IL-7Rα ligands of Formula (27)-(27e), $X^{20}$ can be L.

In IL-7Rα ligands of Formula (27)-(27e), $X^{21}$ can be selected from A, E, G, H, K, L, M, N, Q, R, S, T, and V.

In IL-7Rα ligands of Formula (27)-(27e), $X^{21}$ can be selected from R, S, and T.

In IL-7Rα ligands of Formula (27)-(27e), $X^{22}$ can be selected from A, D, E, G, H, I, K, L, M, N, Q, R, T, and Y.

In IL-7Rα ligands of Formula (27)-(27e), $X^{22}$ can be selected from G, K, N, R, and S.

In IL-7Rα ligands of Formula (27)-(27e), $X^{23}$ can be selected from A, D, E, F, G, H, I, K, L, M, N, Q, R, S, T, V, W and Y.

In IL-7Rα ligands of Formula (27)-(27e), $X^{24}$ can be selected from A, E, F, G, K, L, N, Q, R, V, W, and Y.

In IL-7Rα ligands of Formula (27)-(27e), $X^{24}$ can be selected from E, G, and K.

In IL-7Rα ligands of Formula (27)-(27e), $X^{25}$ can be selected from A, D, E, G, H, K, N, P, S, T, V, and W.

In IL-7Rα ligands of Formula (27)-(27e), $X^{25}$ can be selected from E, K, and S.

In IL-7Rα ligands of Formula (27)-(27e), $X^{26}$ can be selected from D, E, G, H, K, N, Q, R, S, V, and W.

In IL-7Rα ligands of Formula (27)-(27e), $X^{26}$ can be selected from G, K, and R.

In IL-7Rα ligands of Formula (27)-(27e), the IL-7Rα ligand can be defined by any combination of $X^1$-$X^{12}$ as defined in the immediately preceding fifty (50) paragraphs.

In IL-7Rα ligands of Formula (27)-(27e), $X^1$ can be selected from D, E, G, H, I, K, M, N, Q, R, S, T, V, W, and Y;

$X^2$ can be selected from A, C, D, E, F, G, H, K, N, P, Q, R, S, T, V, and W;

$X^3$ can be selected from E, F, G, H, I, K, L, M, N, Q, R, S, and W;

$X^4$ can be selected from A, D, E, F, G, H, I, K, L, M, N, Q, R, S, T, V, W, and Y;

$X^5$ can be selected from A, C, D, E, F, F, G, H, I, K, L, M, N, Q, R, S, T, V, and W;

$X^6$ can be selected from A, D, E, F, G, H, I, K, L, M, P, Q, R, S, T, V, and Y;

$X^7$ can be selected from D, I, L, and V;

$X^8$ can be selected from D, F, N, P, and R;

$X^9$ can be selected from G, S, and W;

$X^{10}$ can be selected from A, D, E, H, I, K, L, M, N, Q, R, S, T, and V;

$X^{11}$ can be selected from D, L, and W;

$X^{12}$ can be selected from A, D, H, Q, and W;

$X^{13}$ can be P;

$X^{14}$ can be G;

$X^{15}$ can be selected from A, G, and S;

$X^{16}$ can be selected from F, I, L, M, Q, V, and Y;

$X^{17}$ can be selected from H, Q, and R;

$X^{18}$ can be selected from A, D, E, G, H, K, L, M, Q, S, T, V, and W;

$X^{19}$ can be selected from F, R, W, and Y;

$X^{20}$ can be selected from F, I, L, M, Q, S, V, W, and Y;

$X^{21}$ can be selected from A, E, G, H, K, L, M, N, Q, R, S, T, and V;

$X^{22}$ can be selected from A, D, E, G, H, I, K, L, M, N, Q, R, T, and Y;

$X^{23}$ can be selected from A, D, E, F, G, H, I, K, L, M, N, Q, R, S, T, V, W, and Y;

$X^{24}$ can be selected from A, E, F, G, K, L, N, Q, R, V, W, and Y;

$X^{25}$ can be selected from A, D, E, G, H, K, N, P, S, T, V, and W; and $X^{26}$ can be selected from D, E, G, H, K, N, Q, R, S, V, and W.

In IL-7Rα ligands of Formula (27)-(27e), $X^1$ can be G;

$X^2$ can be selected from A, C, D, E, F, G, H, K, N, P, Q, R, S, T, V, and W;

$X^3$ can be selected from E, F, G, H, I, K, L, M, N, Q, R, S, and W;

$X^4$ can be selected from D, E, G, R, S, T, and W;

$X^5$ can be selected from G, R, S, and T;

$X^6$ can be selected from G, R, S, T, and V;

$X^7$ can be selected from I and V;

$X^8$ can be P;

$X^9$ can be W;

$X^{10}$ can be selected from L, M, S, and T;

$X^{11}$ can be L;

$X^{12}$ can be D;

$X^{13}$ can be P;

$X^{14}$ can be G;

$X^{15}$ can be S;

$X^{16}$ can be L;

$X^{17}$ can be Q;

$X^{18}$ can be A;

$X^{19}$ can be W;

$X^{20}$ can be L;

$X^{21}$ can be selected from R, S, and T;

$X^{22}$ can be selected from G, K, N, R, and S;

$X^{23}$ can be selected from A, D, E, F, G, H, I, K, L, M, N, Q, R, S, T, V, W, and Y;

$X^{24}$ can be selected from E, G, and K;

$X^{25}$ can be selected from E, K, and S; and $X^{26}$ can be selected from G, K, and R.

In IL-7Rα ligands of Formula (27)-(27e), $X^1$ can be G;

$X^2$ can be selected from A, C, D, E, F, G, H, K, N, P, Q, R, S, T, V, and W;

$X^3$ can be selected from E, F, G, H, I, K, L, M, N, Q, R, S, and W;

$X^4$ can be G;

$X^5$ can be selected from G, R, S, and T;

$X^6$ can be G;

$X^7$ can be selected from I and V;

$X^8$ can be P;

$X^9$ can be W;

$X^{10}$ can be T;

$X^{11}$ can be L;

$X^{12}$ can be D;

$X^{13}$ can be P;

$X^{14}$ can be G;

$X^{15}$ can be S;

$X^{16}$ can be L;

$X^{17}$ can be Q;

$X^{18}$ can be A;

$X^{19}$ can be W;
$X^{20}$ can be L;
$X^{21}$ can be selected from R, S, and T;
$X^{22}$ can be selected from G, K, N, R, and S;
$X^{23}$ can be selected from A, D, E, F, G, H, I, K, L, M, N, Q, R, S, T, V, W, and Y;
$X^{24}$ can be selected from E, G, and K;
$X^{25}$ can be selected from E, K, and S; and
$X^{26}$ can be selected from G, K, and R.

In IL-7Rα ligands of Formula (27)-(27e),
$X^7$ can be selected from I and V;
$X^8$ can be P;
$X^9$ can be W;
$X^{10}$ can be T;
$X^{11}$ can be L;
$X^{12}$ can be D;
$X^{13}$ can be P;
$X^{14}$ can be G;
$X^{15}$ can be S;
$X^{16}$ can be L;
$X^{17}$ can be Q;
$X^{18}$ can be A;
$X^{19}$ can be W; and
$X^{20}$ can be L.

An IL-7Rα ligand can comprise an amino acid sequence selected from any one of SEQ ID NO: 2190-2349.

SEQ ID NO: 2190
A R H V P W C T L D P G S I Q C A W L R A N

SEQ ID NO: 2191
A H Y I P W C T L D P G S L Q C A W L Q S H

SEQ ID NO: 2192
D L S I P W C M L D P G S L Q C S Y I T K F

SEQ ID NO: 2193
D R M V T G I P W C L L D P G S I Q C A W L

SEQ ID NO: 2194
D M S I P W C N L D P G S L Q C A W I R A N

SEQ ID NO: 2195
E N H W T R I P W C I L D P G S I Q C A W L

SEQ ID NO: 2196
E R R I P W C H L D P G S L Q C A W L S R H

SEQ ID NO: 2197
E K R F V E I P W C T L D P G S X Q C A Y L

SEQ ID NO: 2198
E F R W S V I P W C T L D P G S V Q C A W L

SEQ ID NO: 2199
E T R I P W C S L D P D S L Q C A Y L Q A H

SEQ ID NO: 2200
E Y L G R I P W C T L D P G S L Q C A W L

SEQ ID NO: 2201
F V S I P W C S L D P G S L Q C A W V T Y N

SEQ ID NO: 2202
F T G V P W C L L D P G S L Q C T W L K I G

SEQ ID NO: 2203
F V I P W C T L D P G G L Q C A F I K G T

SEQ ID NO: 2204
H L G V P W C T L D P G S I Q C A W L A K H

SEQ ID NO: 2205
H S W S E I P W C T L D P G S I Q C A W I

SEQ ID NO: 2206
H F L G L T I P W C S L D P G S L Q C A W I

SEQ ID NO: 2207
I R S C L W Q P G A L H C T W W A E E E P V

SEQ ID NO: 2208
I P W C T L D P G S L Q C A W L Q K F G E G

SEQ ID NO: 2209
I P W C I L D P G S V Q C A W L M Q E K K E

SEQ ID NO: 2210
I P W C T L D P G S V Q C D Y L L K S A K Q

SEQ ID NO: 2211
I P W C T L D P G S L Q C A W L T N T G A K

SEQ ID NO: 2212
I P W C T L D P G S L Q C A W L Q G K E E R

SEQ ID NO: 2213
I G Q V S R V P W C L L D P G S Y Q C G W L

SEQ ID NO: 2214
I Q V P W C M L A P G S L Q C A Y I T R H

SEQ ID NO: 2215
I P W C T L D P G S L Q C A W L

SEQ ID NO: 2216
I P W C L L D P G G L Q C V W L

SEQ ID NO: 2217
I P W C T L D P G S L Q C A W L E E R R S K

SEQ ID NO: 2218
I P W C M L D P G S V Q C L W L A T Q E N G

SEQ ID NO: 2219
I P W C S L D P G G L Q C A W L

SEQ ID NO: 2220
I P W C S L D P G S L Q C A W M

SEQ ID NO: 2221
I P W C T L D P G S L Q C A W L S T Q K V N

SEQ ID NO: 2222
I P W C T L D P G S I Q C A W M

SEQ ID NO: 2223
I P W C M L D P G S I Q C A W L

SEQ ID NO: 2224
I P W C K L D P G S I Q C V W L

SEQ ID NO: 2225
I P W C K L D P G S L Q C A Y Y

SEQ ID NO: 2226
I P W C T L D P G S L Q C A W V

SEQ ID NO: 2227
I P W C T L D P G S L Q C A W L

SEQ ID NO: 2228
I P W C M L D P G S L Q C A W M

SEQ ID NO: 2229
I P W C T L D P G S F Q C A W L

SEQ ID NO: 2230
I P W C I L D P G S V Q C A F L

SEQ ID NO: 2231
I P W C T L D P G S L Q C A W L Q K F G E G

SEQ ID NO: 2232
I P W C A L D P G S L Q C A W L R S H G S E

IPWCTLDPGSLQCAYL SEQ ID NO: 2233

INWCLLDPGSLQCAWIRGDHG SEQ ID NO: 2234

INWCLLDPGSLQCAWIRGDHG SEQ ID NO: 2235

IPWCSLDPGSLQCAFY SEQ ID NO: 2236

IPWCTLDPGSIQCAFLQDMTSK SEQ ID NO: 2237

IPWCTLDPGSIQCAWLQRDPDL SEQ ID NO: 2238

IPWCTLDPGSIQCGWLKIQDKL SEQ ID NO: 2239

IPWCTLDPGSIQCVWVKEHLTR SEQ ID NO: 2240

IPWCLLDPGSLQCSYLKEAAEP SEQ ID NO: 2241

IPWCRLDPGSLQCLWQMRHAEN SEQ ID NO: 2242

IPWCTLDPGSLQCAFILGKTNS SEQ ID NO: 2243

IPWCALDPGSVQCAWLRRRGQR SEQ ID NO: 2244

IPWCLLDPGSVQCAYSKQGERA SEQ ID NO: 2245

IPWCTLDPGSVQCTWMKGQRAR SEQ ID NO: 2246

KAGSWFIPWCTLDPGSLQCAFL SEQ ID NO: 2247

KRRDSVIPWCLLDPGSLQCTWL SEQ ID NO: 2248

KRRIPWCSLDPGSLQCAYLERT SEQ ID NO: 2249

KTRIPWCTLDPGSIQCAWFMLY SEQ ID NO: 2250

LPWCTDHPGGQQCWWLEDREKR SEQ ID NO: 2251

LISVPWCTLDPGSLQCAWLSRQ SEQ ID NO: 2252

MGGIPWCSLDPGSIQCAFLKKG SEQ ID NO: 2253

MQGGLGIPWCMLDPGSLQCLWL SEQ ID NO: 2254

METIPWCTLDPGSLQCHWIISS SEQ ID NO: 2255

MIHVPWCQLDPGGLQCAWLNDI SEQ ID NO: 2256

MCNSCFVPWCSLDPGSLQCAWLR SEQ ID NO: 2257

NPFRSVVPWCALDPGSLQCAWL SEQ ID NO: 2258

NRMIPWCELWPGSIQCAWITDL SEQ ID NO: 2259

NWSRSDVPWCTLDPGSIQCAFL SEQ ID NO: 2260

NQQVPWCSLDPGGLQCEWLKNR SEQ ID NO: 2261

QMQVPWCSLDPGSLQCAWMNNY SEQ ID NO: 2262

QWVVPWCMLDPGSLQCEWLKAN SEQ ID NO: 2263

QAGWRGDFWCSLDPGSQRCVRW SEQ ID NO: 2264

QNKVPWCLLDPGSLQCAWLRSN SEQ ID NO: 2265

QTVVPWCTLDPGSLQCAWLSRQ SEQ ID NO: 2266

QTLVPWCSLDPGSLQCTWLLKA SEQ ID NO: 2267

QHRIPWCALDPGGIQCAYLHRQ SEQ ID NO: 2268

RHFDDIIPWCTLDPGSLQCAYL SEQ ID NO: 2269

RVQMSFIPWCILDPGSLQCAWL SEQ ID NO: 2270

RDWTSGIPWCVLDPGSLQCQFL SEQ ID NO: 2271

RFSVTSVPWCLLDPGSLQCEFL SEQ ID NO: 2272

RSAVPWCTLDPGSIQCAYLRNQ SEQ ID NO: 2273

RWIDTVIPWCSLDPGGLQCLWL SEQ ID NO: 2274

RREIPWCTLDPGGLQCSWLRSI SEQ ID NO: 2275

RNPIPWCTLDPGGLQCAWLEEH SEQ ID NO: 2276

RNAIPWCDLDPGSLQCAYLRKH SEQ ID NO: 2277

RPVVCATLPGGYVCRVT SEQ ID NO: 2278

SLTVPWCTLDPGSMQCAWLQNR SEQ ID NO: 2279

SGKWGDIPWCTLDPGSIQCAWL SEQ ID NO: 2280

SEMGESIPWCQLDPGSVQCAWL SEQ ID NO: 2281

SNIVPWCTLDPGGLQCAWIMGR SEQ ID NO: 2282

SRRIPWCTLDPGSLQCAWLRHQ SEQ ID NO: 2283

SINHGQIPWCTLDPGSLQCTWL SEQ ID NO: 2284

SWSVPWCTLDPGSMQCVWLQMQ SEQ ID NO: 2285

TTEIQDIPWCELDPGSLQCAYM SEQ ID NO: 2286

TSRVPGCSLDPGSLQCAWLRHF    SEQ ID NO: 2287

VPWCMLDPGSMQCAWL    SEQ ID NO: 2288

VDWCILDPGSLQCSWLKNMWNK    SEQ ID NO: 2289

VPWCELDPGGLQCSYLRGWVTD    SEQ ID NO: 2290

VLETQVPWCTLDPGSIQCAWL    SEQ ID NO: 2291

VPWCILDPGSVQCAWLRDNQVW    SEQ ID NO: 2292

VPWCTLDPGSYQCAWL    SEQ ID NO: 2293

VGSTMRIPWCSLDPGSLQCEYL    SEQ ID NO: 2294

VHRIPWCTLDPGGLQCAWLRQM    SEQ ID NO: 2295

VPWCTLDPGSLQCKWL    SEQ ID NO: 2296

VPWCRLDPGSIQCAYLRSEQKS    SEQ ID NO: 2297

VAGVPWCSLDPGSLQCHWLNEH    SEQ ID NO: 2298

VPWCTLDPGSIQCAYLKNQVDG    SEQ ID NO: 2299

VRYVPWCTLDPGSIQCAYLQEQ    SEQ ID NO: 2300

VPWCNLDPGGLQCEWLTRVLGR    SEQ ID NO: 2301

VPWCMLDPGSLQCSWLQQTFSN    SEQ ID NO: 2302

VPWCTLDPGGIQCAWL    SEQ ID NO: 2303

VPWCTLDPGSIQCHWL    SEQ ID NO: 2304

VPWCTLDPGSFQCAWL    SEQ ID NO: 2305

VPWCLLDPGSVQCAFLNRQKED    SEQ ID NO: 2306

VPWCMLDPGSLQCMYL    SEQ ID NO: 2307

VPWCMLDPGSIQCAFL    SEQ ID NO: 2308

VPWCTLDPGGLQCAWMRGTYSQ    SEQ ID NO: 2309

VPWCRLDPGSVQCAWLRSRNNV    SEQ ID NO: 2310

VPWCALDPGSVQCAFL    SEQ ID NO: 2311

VPWCMLDPGSLQCMYL    SEQ ID NO: 2312

VPWCTLDPGSLQCAWF    SEQ ID NO: 2313

VPWCILDPGSLQCAYL    SEQ ID NO: 2314

VPWCHLDPGGIQCAYL    SEQ ID NO: 2315

VPWCSLDPGSLQCHWQVSRGWH    SEQ ID NO: 2316

VPWCELDPGSLQCAWLQTWGVN    SEQ ID NO: 2317

VPWCKIDPGSLQCAYLKRHQIL    SEQ ID NO: 2318

VPWCKLDPGSFQCAFLRELERQ    SEQ ID NO: 2319

VPWCLLDPGSLQCAWLKRMEVD    SEQ ID NO: 2320

VPWCLLDPGSLQCAWMRSGEGK    SEQ ID NO: 2321

VPWCLLDPGSLQCAYLEGKWDL    SEQ ID NO: 2322

VPWCMLDPGSIQCAWINEQNML    SEQ ID NO: 2323

VPWCMLDPGSLQCAWMRSQREE    SEQ ID NO: 2324

VPWCTIDPGSLQCTWLRVHRGE    SEQ ID NO: 2325

VPWCTLDPGSLQCAWLEKESRT    SEQ ID NO: 2326

VPWCTLDPGSLQCAWLISNARE    SEQ ID NO: 2327

VPWCTLDPGSLQCAWLKIQEAL    SEQ ID NO: 2328

VPWCTLDPGSLQCAWLKKHEGG    SEQ ID NO: 2329

VPWCTLDPGSLQCAWLNNHRSR    SEQ ID NO: 2330

VPWCTLDPGSLQCDWLMKRRNT    SEQ ID NO: 2331

VPWCTLDPGSLQCDYLKWMNMR    SEQ ID NO: 2332

VPWCTLDPGSLQCHWLLSRSDN    SEQ ID NO: 2333

VPWCTLDPGSVQCAYLKARRPS    SEQ ID NO: 2334

VPWCVLDPGSIQCEYLQRLHRQ    SEQ ID NO: 2335

WRRVPWCTLDPGSLQCAWLNSH    SEQ ID NO: 2336

WGIPWCTLDPGSLQCAWLGKH    SEQ ID NO: 2337

WTQIPWCTLDPGSIQCSWLSRE    SEQ ID NO: 2338

WVTIPWCILDPGSLQCEWQTKV    SEQ ID NO: 2339

WTQVPWCTLDPGSLQCDWLSKR    SEQ ID NO: 2340

|          |                                  |
|----------|----------------------------------|
| W E R D S E I P W C T L D P G S L Q C A W L | SEQ ID NO: 2341 |
| W F E I P W C T L D P G S L Q C E W S M Q N | SEQ ID NO: 2342 |
| W R Q T L Q I P W C S L D P G S L Q C A Y L | SEQ ID NO: 2343 |
| Y S G R R E I P W C T L D P G S L Q C T W L | SEQ ID NO: 2344 |
| Y R S G H G I P W C M L D P G G L Q C S W L | SEQ ID NO: 2345 |
| Y K G V S E I P W C V L D P G S V Q C A Y L | SEQ ID NO: 2346 |
| Y K Y I P W C T L D P G S L Q C A W L A R N | SEQ ID NO: 2347 |
| Y Q P V P W C T L D P G S L Q C A W L S N I | SEQ ID NO: 2348 |
| Y N F V P W C M L D P G S L Q C A Y L R K T | SEQ ID NO: 2349 |

An IL-7Rα ligand provided by the present disclosure can comprise a truncated amino acid sequence of any one of SEQ ID NOS: 2184-2349.

An IL-7Rα ligand provided by the present disclosure can comprise an amino acid sequence selected from any one of SEQ ID NOS: 2184-2349, or a truncated amino acid sequence of any one of SEQ ID NOS: 2184-2349, wherein the amino acid sequence can independently comprise from 1 to 4 glycines (G) (SEQ ID NO: 9615) on the N-terminus, on the C-terminus, or on both the N- and C-termini.

An IL-7Rα ligand provided by the present disclosure can comprise an amino acid sequence selected from any one of SEQ ID NOS: 2184-2349, or a truncated amino acid sequence of any one of SEQ ID NOS: 2184-2349, wherein the amino acid sequence comprises one or more amino acid substitutions such as from 1 to 5 amino acid substitutions. The amino acid substitutions can comprise conservative amino acid substitutions.

An IL-7Rα ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2184-2349 or a truncated amino acid sequence of any one of SEQ ID NOS: 2184-2349.

An IL-7Rα ligand of any one of SEQ ID NOS: 2184-2349 can bind to the hIL-7Rα subunit with an $IC_{50}$ of less than 10 μM as determined using phage ELISA competition assays.

An IL-7Rα ligand of any one of SEQ ID NOS: 2184-2349, a truncated IL-7Rα ligand of any one of SEQ ID NOS: 2184-2349, or a substituted IL-7Rα ligand of any one of SEQ ID NOS: 2184-2349 can bind to the hIL-7Rα subunit with an $IC_{50}$ of less than 100 μM or less than 10 μM as determined using phage ELISA competition assays.

An IL-7Rα ligand of any one of SEQ ID NOS: 2190-2349 bind to the hIL-7Rα subunit with an $IC_{50}$ of less than 100 μM.

An IL-7Rα ligand can comprise an amino acid sequence of any one of SEQ ID NOS: 2350-2388, which are included in the Family 3A IL-7Rα ligands.

An IL-7Rα ligand can comprise the amino acid sequence of Formula (28) (SEQ ID NO: 2350), an amino acid sequence of Formula (28a) (SEQ ID NO: 2351), an amino acid sequence of Formula (28b) (SEQ ID NO: 2352), an amino acid sequence of Formula (28c) (SEQ ID NO: 2353), an amino acid sequence of Formula (28d) (SEQ ID NO: 2354), or an amino acid sequence of Formula (28e) (SEQ ID NO: 2355):

$$-X^1\text{-}X^2\text{-}X^3\text{-}X^4\text{-}X^5\text{-}X^6\text{-}C\text{-}X^7\text{-}X^8\text{-}X^9\text{-}X^{10}\text{-}X^{11}\text{-}X^{12}\text{-}X^{13}\text{-}X^{14}\text{-}C\text{-}X^{15}\text{-}X^{16}\text{-}X^{17}\text{-}X^{18}\text{-}X^{19}\text{-}X^{20}\text{-} \quad (28)$$

$$-X^4\text{-}X^5\text{-}X^6\text{-}C\text{-}X^7\text{-}X^8\text{-}X^9\text{-}X^{10}\text{-}X^{11}\text{-}X^{12}\text{-}X^{13}\text{-}X^{14}\text{-}C\text{-}X^{15}\text{-}X^{16}\text{-}X^{17}\text{-} \quad (28a)$$

$$-X^5\text{-}X^6\text{-}C\text{-}X^7\text{-}X^8\text{-}X^9\text{-}X^{10}\text{-}X^{11}\text{-}X^{12}\text{-}X^{13}\text{-}X^{14}\text{-}C\text{-}X^{15}\text{-}X^{16}\text{-} \quad (28b)$$

$$-X^6\text{-}C\text{-}X^7\text{-}X^8\text{-}X^9\text{-}X^{10}\text{-}X^{11}\text{-}X^{12}\text{-}X^{13}\text{-}X^{14}\text{-}C\text{-}X^{15}\text{-} \quad (28c)$$

$$-C\text{-}X^7\text{-}X^8\text{-}X^9\text{-}X^{10}\text{-}X^{11}\text{-}X^{12}\text{-}X^{13}\text{-}X^{14}\text{-}C\text{-} \quad (28d)$$

$$-X^7\text{-}X^8\text{-}X^9\text{-}X^{10}\text{-}X^{11}\text{-}X^{12}\text{-}X^{13}\text{-}X^{14}\text{-} \quad (28e)$$

wherein, $X^1$ can be selected from an amino acid;
$X^2$ can be selected from an amino acid;
$X^3$ can be selected from an amino acid;
$X^4$ can be selected from an amino acid comprising a basic side chain;
$X^5$ can be selected from an amino acid comprising a large hydrophobic side chain;
$X^6$ can be selected from an amino acid comprising an acidic side chain or an amino acid comprising a large hydrophobic side chain;
$X^7$ can be selected from an amino acid comprising a small hydrophobic side chain;
$X^8$ can be selected from an amino acid comprising an acidic side chain;
$X^9$ can be selected from an amino acid comprising a large hydrophobic side chain;
$X^{10}$ can be selected from an amino acid comprising a small hydrophobic side chain;
$X^{11}$ can be selected from an amino acid comprising a small hydrophobic side chain;
$X^{12}$ can be selected from an amino acid comprising a small hydrophobic side chain;
$X^{13}$ can be selected from an amino acid comprising a basic side chain or an amino acid comprising a large hydrophobic side chain;
$X^{14}$ can be selected from an amino acid comprising a polar/neutral side chain or a large hydrophobic side chain;
$X^{15}$ can be selected from an amino acid comprising a basic side chain;
$X^{16}$ can be selected from an amino acid comprising a large hydrophobic side chain;
$X^{17}$ can be selected from an amino acid comprising a basic side chain;
$X^{18}$ can be selected from an amino acid;
$X^{19}$ can be selected from an amino acid; and
$X^{20}$ can be selected from an amino acid.

In IL-7Rα ligands of Formula (28)-(28e), $X^1$ can be selected from G, K, L, R, and T.

In IL-7Rα ligands of Formula (28)-(28e), $X^1$ can be selected from G and R.

In IL-7Rα ligands of Formula (28)-(28e), $X^1$ can be G.

In IL-7Rα ligands of Formula (28)-(28e), $X^2$ can be selected from D, F, G, K, N, and R.

In IL-7Rα ligands of Formula (28)-(28e), $X^2$ can be selected from G, K, N, and R.

In IL-7Rα ligands of Formula (28)-(28e), $X^3$ can be selected from A, C, E, F, G, L, M, R, and V.

In IL-7Rα ligands of Formula (28)-(28e), $X^3$ can be G.

In IL-7Rα ligands of Formula (28)-(28e), $X^4$ can be selected from H, I, L, P, Q, and R.

In IL-7Rα ligands of Formula (28)-(28e), $X^4$ can be R.

In IL-7Rα ligands of Formula (28)-(28e), $X^5$ can be selected from I, L, Q, V, and Y.

In IL-7Rα ligands of Formula (28)-(28e), $X^5$ can be selected from I, L, and V.

In IL-7Rα ligands of Formula (28)-(28e), $X^6$ can be selected from D, E, and Y.

In IL-7Rα ligands of Formula (28)-(28e), $X^6$ can be selected from E and Y.

In IL-7Rα ligands of Formula (28)-(28e), $X^7$ can be selected from A, E, and Q.

In IL-7Rα ligands of Formula (28)-(28e), $X^7$ can be A.

In IL-7Rα ligands of Formula (28)-(28e), $X^8$ can be selected from D, E, K, N, Q, and S.

In IL-7Rα ligands of Formula (28)-(28e), $X^8$ can be selected from D and E.

In IL-7Rα ligands of Formula (28)-(28e), $X^9$ can be selected from F and L.

In IL-7Rα ligands of Formula (28)-(28e), $X^9$ can be L.

In IL-7Rα ligands of Formula (28)-(28e), $X^{10}$ can be P.

In IL-7Rα ligands of Formula (28)-(28e), $X^{11}$ can be G.

In IL-7Rα ligands of Formula (28)-(28e), $X^{12}$ can be G.

In IL-7Rα ligands of Formula (28)-(28e), $X^{13}$ can be selected from F, H, K, L, Q, and R.

In IL-7Rα ligands of Formula (28)-(28e), $X^{13}$ can be selected from F, L, and R.

In IL-7Rα ligands of Formula (28)-(28e), $X^{14}$ can be selected from A, H, I, N, Q, T, and V.

In IL-7Rα ligands of Formula (28)-(28e), $X^{14}$ can be selected from A, H, Q, and V.

In IL-7Rα ligands of Formula (28)-(28e), $X^{14}$ can be V.

In IL-7Rα ligands of Formula (28)-(28e), $X^{15}$ can be selected from E, K, and R.

In IL-7Rα ligands of Formula (28)-(28e), $X^{16}$ can be selected from A, C, F, G, L, M, S, and V.

In IL-7Rα ligands of Formula (28)-(28e), $X^{16}$ can be selected from L and S.

In IL-7Rα ligands of Formula (28)-(28e), $X^{16}$ can be L.

In IL-7Rα ligands of Formula (28)-(28e), $X^{17}$ can be selected from G, H, R, and W.

In IL-7Rα ligands of Formula (28)-(28e), $X^{17}$ can be R.

In IL-7Rα ligands of Formula (28)-(28e), $X^{18}$ can be selected from D, E, G, H, K, S, T, and V.

In IL-7Rα ligands of Formula (28)-(28e), $X^{18}$ can be selected from E and S.

In IL-7Rα ligands of Formula (28)-(28e), $X^{19}$ can be selected from A, D, E, M, Q, S, V, and W.

In IL-7Rα ligands of Formula (28)-(28e), $X^{19}$ can be selected from A and S.

In IL-7Rα ligands of Formula (28)-(28e), $X^{20}$ can be selected from D, E, G, I, L, M, R, and S.

In IL-7Rα ligands of Formula (28)-(28e), $X^{20}$ can be selected from D and E.

In IL-7Rα ligands of Formula (28)-(28e), the IL-7Rα ligand can be defined by any combination of $X^1$-$X^{12}$ as defined in the immediately preceding thirty nine (39) paragraphs.

In IL-7Rα ligands of Formula (28)-(28e),
$X^1$ can be selected from G, K, L, R, and T;
$X^2$ can be selected from D, F, G, K, N, and R;
$X^3$ can be selected from A, C, E, F, G, L, M, R, and V;
$X^4$ can be selected from H, I, L, P, Q, and R;
$X^5$ can be selected from I, L, Q, V, and Y;
$X^6$ can be selected from D, E, and Y;
$X^7$ can be selected from A, E, and Q;
$X^8$ can be selected from D, E, K, N, Q, and S;
$X^9$ can be selected from F and L;
$X^{10}$ can be P;
$X^{11}$ can be G;
$X^{12}$ can be G;
$X^{13}$ can be selected from F, H, K, L, Q, and R;
$X^{14}$ can be selected from A, H, I, N, Q, T, and V;
$X^{15}$ can be selected from E, K, and R;
$X^{16}$ can be selected from A, C, F, G, L, M, S, and V;
$X^{17}$ can be selected from G, H, R, and W;
$X^{18}$ can be selected from D, E, G, H, K, S, T, and V;
$X^{19}$ can be selected from A, D, E, M, Q, S, V, and W; and
$X^{20}$ can be selected from D, E, G, I, L, M, R, and S.

In IL-7Rα ligands of Formula (28)-(28e),
$X^1$ can be selected from G and R;
$X^2$ can be selected from G, K, N, and R;
$X^3$ can be G;
$X^4$ can be selected from H, I, L, P, Q, and R;
$X^5$ can be selected from I, L, and V;
$X^6$ can be selected from E and Y;
$X^7$ can be A;
$X^8$ can be selected from D and E;
$X^9$ can be L;
$X^{10}$ can be P;
$X^{11}$ can be G;
$X^{12}$ can be G;
$X^{13}$ can be selected from F, L, and R;
$X^{14}$ can be selected from A, H, Q, and V;
$X^{15}$ can be selected from E, K, and R;
$X^{16}$ can be selected from L and S;
$X^{17}$ can be R;
$X^{18}$ can be selected from E and S;
$X^{19}$ can be selected from A and S; and
$X^{20}$ can be selected from D and E.

In IL-7Rα ligands of Formula (28)-(28e),
$X^1$ can be G;
$X^2$ can be selected from G, K, N, and R;
$X^3$ can be G;
$X^4$ can be R;
$X^5$ can be selected from I, L, and V;
$X^6$ can be selected from E and Y;
$X^7$ can be A;
$X^8$ can be selected from D and E;
$X^9$ can be L;
$X^{10}$ can be P;
$X^{11}$ can be G;
$X^{12}$ can be G;
$X^{13}$ can be selected from F, L, and R;
$X^{14}$ can be V;
$X^{15}$ can be selected from E, K, and R;
$X^{16}$ can be L;
$X^{17}$ can be R;
$X^{18}$ can be selected from E and S;
$X^{19}$ can be selected from A and S; and
$X^{20}$ can be selected from D and E.

In IL-7Rα ligands of Formula (28)-(28e),
$X^4$ can be R;
$X^5$ can be selected from I, L, and V;
$X^6$ can be selected from E and Y;
$X^7$ can be A;
$X^8$ can be selected from D and E;
$X^9$ can be L;
$X^{10}$ can be P;
$X^{11}$ can be G;

$X^{12}$ can be G;

$X^{13}$ can be selected from F, L, and R;

$X^{14}$ can be V;

$X^{15}$ can be selected from E, K, and R;

$X^{16}$ can be L; and $X^{17}$ can be R.

An IL-7Rα ligand can comprise an amino acid sequence selected from any one of SEQ ID NOS: 2356-2388.

```
                                    SEQ ID NO: 2356
F R L E C A D L P G G R N C R L R T S G

SEQ ID NO: 2357
I L E C A E L P G G R H C R L R

SEQ ID NO: 2358
K G V R L Y C A D L P G G R I C R S G K V E

SEQ ID NO: 2359
L R L L Q Y C A D L P G G F N C R V R E D L

SEQ ID NO: 2360
P V E C A E F P G G R V C R L R

SEQ ID NO: 2361
Q I D C A D L P G G H V C R L R

SEQ ID NO: 2362
R V E C A Q L P G G K V C R L R

SEQ ID NO: 2363
R G C R L D C A D L P G G H T C R C R S A D

SEQ ID NO: 2364
R I E C A D L P G G H V C R L R

SEQ ID NO: 2365
R K M H L E C A D L P G G R H C R L R H E M

SEQ ID NO: 2366
R N G R I E C A D L P G G F V C R M R D M D

SEQ ID NO: 2367
R D V R L E C A D L P G G H V C R L R D S R

SEQ ID NO: 2368
R K A R I D C A E L P G G R Q C R L H G W S

SEQ ID NO: 2369
R V E C A Q L P G G K V C R M R

SEQ ID NO: 2370
R V E C A E L P G G F V C R L R

SEQ ID NO: 2371
R V Y C A D L P G G R Q C R S H

SEQ ID NO: 2372
R I Y C A E L P G G Q V C R S R

SEQ ID NO: 2373
R R E P V Y C A D L P G G L H C R V R V S E

SEQ ID NO: 2374
R L E C A D L P G G R A C R L R

SEQ ID NO: 2375
R V Y C A D L P G G R Q C R S H

SEQ ID NO: 2376
R V Y C A E L P G G L A C R G R

SEQ ID NO: 2377
R N G R V Y C A D L P G G R Q C R S W G A I

SEQ ID NO: 2378
R L E C A N L P G G F N C R L R

SEQ ID NO: 2379
R L E C A D L P G G R H C R L R

SEQ ID NO: 2380
R L E C A K L P G G F N C R L R

SEQ ID NO: 2381
R I E C A E L P G G F T C R L R

SEQ ID NO: 2382
R I Y C E S L P G G F N C R L R

SEQ ID NO: 2383
R V Y C A E L P G G L A C R L R

SEQ ID NO: 2384
R Y E C A D L P G G L H C E F R

SEQ ID NO: 2385
R V E C A E L P G G F H C R L R

SEQ ID NO: 2386
R V E C A D L P G G R V C K S R

SEQ ID NO: 2387
R V E C A D L P G G L A C R L R

SEQ ID NO: 2388
T F R R V Y C Q E L P G G L V C R A H S Q D
```

An IL-7Rα ligand provided by the present disclosure can comprise a truncated amino acid sequence of any one of SEQ ID NOS: 2350-2388.

An IL-7Rα ligand provided by the present disclosure can comprise an amino acid sequence selected from any one of SEQ ID NOS: 2350-2388, or a truncated amino acid sequence of any one of SEQ ID NOS: 2350-2388, wherein the amino acid sequence can independently comprise from 1 to 4 glycines (G) (SEQ ID NO: 9615) on the N-terminus, on the C-terminus, or on both the N- and C-termini.

An IL-7Rα ligand provided by the present disclosure can comprise an amino acid sequence selected from any one of SEQ ID NOS: 2350-2388, or a truncated amino acid sequence of any one of SEQ ID NOS: 2350-2388, wherein the amino acid sequence comprises one or more amino acid substitutions such as from 1 to 5 amino acid substitutions. The amino acid substitutions can comprise conservative amino acid substitutions.

An IL-7Rα ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2350-2388 or a truncated amino acid sequence of any one of SEQ ID NOS: 2350-2388.

An IL-7Rα ligand of any one of SEQ ID NOS: 2350-2388 can bind to the hIL-7Rα subunit with an $IC_{50}$ of less than 10 μM as determined using phage ELISA competition assays.

An IL-7Rα ligand of anyone of SEQ ID NOS: 2350-2388, a truncated IL-7Rα ligand of anyone of SEQ ID NOS: 2350-2388, or a substituted IL-7Rα ligand of any one of SEQ ID NOS: 2350-2388 can bind to the hIL-7Rα subunit with an $IC_{50}$ of less than 100 μM or less than 10 μM as determined using phage ELISA competition assays.

An IL-7Rα ligand of any one of SEQ ID NOS: 2356-2388 bind to the hIL-7Rα subunit with an $IC_{50}$ of less than 100 μM.

An IL-7Rα ligand provided by the present disclosure can comprise the amino acid sequence of Formula (29) (SEQ ID NO: 2389), an amino acid sequence of Formula (29a) (SEQ ID NO: 2390), an amino acid sequence of Formula (29b) (SEQ ID NO: 2391), or an amino acid sequence of Formula (29c) (SEQ ID NO: 2392):

$$-X^1-X^2-X^3-X^4-X^5-X^6-X^7-X^8-X^9-X^{10}-X^{11}-X^{12}-X^{13}-X^{14}-X^{15}-X^{16}- \quad (29)$$

$$-X^2-X^3-X^4-X^5-X^6-X^7-X^8-X^9-X^{10}-X^{11}-X^{12}-X^{13}-X^{14}-X^{15}- \quad (29a)$$

$$-X^3-X^4-X^5-X^6-X^7-X^8-X^9-X^{10}-X^{11}-X^{12}-X^{13}-X^{14}- \quad (29b)$$

$$-X^4-X^5-X^6-X^7-X^8-X^9-X^{10}-X^{11}-X^{12}-X^{13}- \quad (29c)$$

wherein, $X^1$ can be selected from an amino acid comprising a large hydrophobic side chain;

$X^2$ can be selected from an amino acid comprising a small hydrophobic side chain or cysteine;

$X^3$ can be selected from an amino acid comprising a large hydrophobic side chain;

$X^4$ can be selected from an amino acid comprising a basic side chain or cysteine;

$X^5$ can be selected from an amino acid comprising a large hydrophobic side chain or an amino acid comprising small hydrophobic side chain;

$X^6$ can be selected from an amino acid comprising a large hydrophobic side chain or an amino acid comprising an acidic side chain;

$X^7$ can be selected from an amino acid comprising an acidic side chain;

$X^8$ can be selected from an amino acid comprising an acidic side chain or an amino acid comprising a small hydrophobic side chain;

$X^9$ can be selected from an amino acid comprising a small hydrophobic side chain;

$X^{10}$ can be selected from an amino acid comprising a large hydrophobic side chain or an amino acid comprising a small hydrophobic side chain;

$X^{11}$ can be selected from an amino acid comprising a large hydrophobic side chain;

$X^{12}$ can be selected from an amino acid comprising a polar/neutral side chain;

$X^{13}$ can be selected from cysteine;

$X^{14}$ can be selected from an amino acid comprising a small hydrophobic side chain or an amino acid comprising a large hydrophobic side chain;

$X^{15}$ can be selected from an amino acid comprising a large hydrophobic side chain; and $X^{16}$ can be selected from an amino acid comprising a large hydrophobic side chain.

In IL-7Rα ligands of Formula (29)-(29c), X can be selected from H, I, Q, and V.

In IL-7Rα ligands of Formula (29)-(29c), $X^1$ can be selected from I, Q, and V.

In IL-7Rα ligands of Formula (29)-(29c), $X^1$ can be I.

In IL-7Rα ligands of Formula (29)-(29c), $X^2$ can be selected from C, P, and R.

In IL-7Rα ligands of Formula (29)-(29c), $X^2$ can be selected from C and P.

In IL-7Rα ligands of Formula (29)-(29c), $X^3$ can be selected from I, K, L, S, V, and W.

In IL-7Rα ligands of Formula (29)-(29c), $X^3$ can be W.

In IL-7Rα ligands of Formula (29)-(29c), $X^4$ can be selected from C and H.

In IL-7Rα ligands of Formula (29)-(29c), $X^5$ can be selected from A, I, L, M, T, and W.

In IL-7Rα ligands of Formula (29)-(29c), $X^5$ can be selected from T and W.

In IL-7Rα ligands of Formula (29)-(29c), $X^6$ can be selected from D, L, and W.

In IL-7Rα ligands of Formula (29)-(29c), $X^6$ can be selected from D and L.

In IL-7Rα ligands of Formula (29)-(29c), $X^7$ can be selected from D, I, L, and Q.

In IL-7Rα ligands of Formula (29)-(29c), $X^7$ can be selected from D and L.

In IL-7Rα ligands of Formula (29)-(29c), $X^7$ can be D.

In IL-7Rα ligands of Formula (29)-(29c), $X^8$ can be selected from D, E, and P.

In IL-7Rα ligands of Formula (29)-(29c), $X^8$ can be selected from E and P.

In IL-7Rα ligands of Formula (29)-(29c), $X^8$ can be P.

In IL-7Rα ligands of Formula (29)-(29c), $X^9$ can be selected from G, S, and T.

In IL-7Rα ligands of Formula (29)-(29c), $X^9$ can be selected from G and S.

In IL-7Rα ligands of Formula (29)-(29c), $X^9$ can be G.

In IL-7Rα ligands of Formula (29)-(29c), $X^{10}$ can be selected from A, G, L, and S.

In IL-7Rα ligands of Formula (29)-(29c), $X^{10}$ can be selected from L and S.

In IL-7Rα ligands of Formula (29)-(29c), $X^{11}$ can be selected from F, I, L, and M.

In IL-7Rα ligands of Formula (29)-(29c), $X^{11}$ can be L.

In IL-7Rα ligands of Formula (29)-(29c), $X^{12}$ can be selected from G, H, L, N, Q, and S.

In IL-7Rα ligands of Formula (29)-(29c), $X^{12}$ can be selected from Q and S.

In IL-7Rα ligands of Formula (29)-(29c), $X^{12}$ can be Q.

In IL-7Rα ligands of Formula (29)-(29c), $X^{13}$ can be C.

In IL-7Rα ligands of Formula (29)-(29c), $X^{14}$ can be selected from A, E, I, L, S, T, and V.

In IL-7Rα ligands of Formula (29)-(29c), $X^{14}$ can be selected from A and V.

In IL-7Rα ligands of Formula (29)-(29c), $X^{15}$ can be selected from F, R, W, and Y.

In IL-7Rα ligands of Formula (29)-(29c), $X^{15}$ can be W.

In IL-7Rα ligands of Formula (29)-(29c), $X^{16}$ can be selected from E, L, Q, and W.

In IL-7Rα ligands of Formula (29)-(29c), $X^{16}$ can be L.

In IL-7Rα ligands of Formula (29)-(29c), the IL-7Rα ligand can be defined by any combination of $X^1$-$X^{16}$ as defined in the immediately preceding thirty five (35) paragraphs.

In IL-7Rα ligands of Formula (29)-(29c), $X^1$ can be selected from H, I, Q, and V;

$X^2$ can be selected from C, P, and R;

$X^3$ can be selected from I, K, L, S, V, and W;

$X^4$ can be selected from C and H;

$X^5$ can be selected from A, I, L, M, T, and W;

$X^6$ can be selected from D, L, and W;

$X^7$ can be selected from D, I, L, and Q;

$X^8$ can be selected from D, E, and P;

$X^9$ can be selected from G, S, and T;

$X^{10}$ can be selected from A, G, L, and S;

$X^{11}$ can be selected from F, I, L, and M;

$X^{12}$ can be selected from G, H, L, N, Q, and S;

$X^{13}$ can be C;

$X^{14}$ can be selected from A, E, I, L, S, T, and V;

$X^{15}$ can be selected from F, R, W, and Y; and $X^{16}$ can be selected from E, L, Q, and W.

In IL-7Rα ligands of Formula (29)-(29c), $X^1$ can be selected from I, Q, and V;

$X^2$ can be selected from C and P;

$X^3$ can be W;

$X^4$ can be selected from C and H;
$X^5$ can be selected from T and W;
$X^6$ can be selected from D and L;
$X^7$ can be selected from D and L;
$X^8$ can be selected from E and P;
$X^9$ can be selected from G and S;
$X^{10}$ can be selected from L and S;
$X^{11}$ can be L;
$X^{12}$ can be selected from Q and S;
$X^{13}$ can be C;
$X^{14}$ can be selected from A and V; and
$X^{15}$ can be W; and
$X^{16}$ can be L.
In IL-7Rα ligands of Formula (29)-(29c),
$X^1$ can be I;
$X^2$ can be selected from C and P;
$X^3$ can be W;
$X^4$ can be selected from C and H;
$X^5$ can be selected from T and W;
$X^6$ can be selected from D and L;
$X^7$ can be D;
$X^8$ can be P;
$X^9$ can be G;
$X^{10}$ can be selected from L and S;
$X^{11}$ can be L;
$X^{12}$ can be Q;
$X^{13}$ can be C;
$X^{14}$ can be selected from A and V;
$X^{15}$ can be W; and
$X^{16}$ can be L.
In IL-7Rα ligands of Formula (29)-(29c),
$X^1$ can be Q;
$X^2$ can be C;
$X^3$ can be selected from I, L, K, and V;
$X^4$ can be H;
$X^5$ can be W;
$X^6$ can be D;
$X^7$ can be selected from I and L;
$X^8$ can be E;
$X^9$ can be selected from S and T;
$X^{10}$ can be L;
$X^{11}$ can be L;
$X^{12}$ can be selected from G, L, N, and S;
$X^{13}$ can be C;
$X^{14}$ can be selected from I, L, and V;
$X^{15}$ can be R; and
$X^{16}$ can be E.
In IL-7Rα ligands of Formula (29)-(29c),
$X^1$ can be selected from I and V;
$X^2$ can be P;
$X^3$ can be W;
$X^4$ can be C;
$X^5$ can be T;
$X^6$ can be L;
$X^7$ can be D;
$X^8$ can be P;
$X^9$ can be G;
$X^{10}$ can be selected from L and S;
$X^{11}$ can be L;
$X^{12}$ can be Q;
$X^{13}$ can be C;
$X^{14}$ can be A;
$X^{15}$ can be W; and
$X^{16}$ can be L.
An IL-7Rα ligand can comprise an amino acid sequence selected from any one of SEQ ID NOS: 2393-2410.

H C L H W D I E T L M S C V Y G N F E E  SEQ ID NO: 2393

H C K H W D L E S L L L C V  SEQ ID NO: 2394

H L G V P W C T L D P G S I Q C A W L A K H  SEQ ID NO: 2395

I R S C L W Q P G A L H C T W W A E E E P V  SEQ ID NO: 2396

I P W C L L D P G G L Q C V W L  SEQ ID NO: 2397

K A G S W F I P W C T L D P G S L Q C A F L  SEQ ID NO: 2398

N P F R S V V P W C A L D P G S L Q C A W L  SEQ ID NO: 2399

Q C I H W D I E T L L S C V  SEQ ID NO: 2400

Q C I H W D L E S L L N C L R E L K E P  SEQ ID NO: 2401

Q C V H W D L D T L F G C I R E Q L E L  SEQ ID NO: 2402

R H F D D I I P W C T L D P G S L Q C A Y L  SEQ ID NO: 2403

S A K V L K Q C L H W D L E S L L S C L  SEQ ID NO: 2404

S L T V P W C T L D P G S M Q C A W L Q N R  SEQ ID NO: 2405

V P W C M L D P G S M Q C A W L  SEQ ID NO: 2406

V H R I P W C T L D P G G L Q C A W L R Q M  SEQ ID NO: 2407

W V T I P W C I L D P G S L Q C E W Q T K V  SEQ ID NO: 2408

W G I P W C T L D P G S L Q C A W L G K H  SEQ ID NO: 2409

Y R S G H G I P W C M L D P G G L Q C S W L  SEQ ID NO: 2410

An IL-7Rα ligand provided by the present disclosure can comprise a truncated amino acid sequence of any one of SEQ ID NOS: 2389-2410.

An IL-7Rα ligand provided by the present disclosure can comprise an amino acid sequence selected from any one of SEQ ID NOS: 2389-2410, or a truncated amino acid sequence of any one of SEQ ID NOS: 2389-2410, wherein the amino acid sequence can independently comprise from 1 to 4 glycines (G) (SEQ ID NO: 9615) on the N-terminus, on the C-terminus, or on both the N- and C-termini.

An IL-7Rα ligand provided by the present disclosure can comprise an amino acid sequence selected from any one of SEQ ID NOS: 2389-2410, or a truncated amino acid sequence of any one of SEQ ID NOS: 2389-2410, wherein the amino acid sequence comprises one or more amino acid substitutions such as from 1 to 5 amino acid substitutions. The amino acid substitutions can comprise conservative amino acid substitutions.

An IL-7Rα ligand can comprise an amino acid sequence having an amino acid sequence similarity greater than 60%, greater than 70%, greater than 75%, greater than 80%, greater than 85%, greater than 90%, or greater than 95% to the amino acid sequence of any one of SEQ ID NOS: 2389-2410 or a truncated amino acid sequence of any one of SEQ ID NOS: 2389-2410.

An IL-7Rα ligand of any one of SEQ ID NOS: 2389-2410 can bind to the hIL-7Rα subunit with an $IC_{50}$ of less than 10 µM as determined using phage ELISA competition assays.

An IL-7Rα ligand of anyone of SEQ ID NOS: 2389-2410, a truncated IL-7Rα ligand of anyone of SEQ ID NOS: 2389-2410, or a substituted IL-7Rα ligand of any one of SEQ ID NOS: 2389-2410 can bind to the hIL-7Rα subunit with an $IC_{50}$ of less than 100 µM or less than 10 µM as determined using phage ELISA competition assays.

An IL-7Rα ligand of any one of SEQ ID NOS: 2393-2410 bind to the hIL-7Rα subunit with and $IC_{50}$ of less than 100 µM.

An IL-7Rα ligand can have an amino acid sequence of any one of SEQ ID NOS: 2601-2602:

```
                                    SEQ ID NO: 2601
G G H L G V P W C T L D P G S I Q C A W L A K H
G G

SEQ ID NO: 2602
Q C V H W D L D T L F G C I R E Q L E L G G
```

Certain IL-7Rα ligands provided by the present disclosure can bind to a specific binding site on the IL-7Rα subunit that is different from the binding site on the IL-7Rα subunit to which IL-7 binds.

IL-7Rα ligands having SEQ ID NOS: 2159, 2043, 2104, 2402, and 2313 do not bind competitively with IL-7 binding to IL-7Rα, indicating that the IL-7Rα ligand binding site for these compounds is distinct from that of IL-7. This group of IL-7Rα ligands bind to a specific binding site on the IL-7Rα subunit with an $IC_{50}$ of less than 10 µM.

Specific binding sites on the IL-7Rα subunit can be characterized by at least the following properties: (1) a group of IL-7Rα ligands bind to each specific binding site on the IL-7Rα subunit with an $IC_{50}$ of less than 10 µM; (2) each of the IL-7Rα ligands within the group competitively bind to the specific binding site on the IL-7Rα subunit with each of the other IL-7Rα ligands within the group; (3) a peptide having the amino acid sequence of SEQ ID NO: 1204 does not compete for binding to a specific binding site on the IL-7Rα subunit with the peptides within the group of IL-7Rα ligands; and (4) IL-7Rα ligands having SEQ ID NOS: 2159, 2043, 2104, 2402, and 2313 do not bind competitively with IL-7 binding to IL-7Rα, indicating that this IL-7Rα ligand binding site is distinct from that of IL-7.

The group of IL-7Rα ligands comprises at least the IL-7Rα ligands having the amino acid sequence of any one of SEQ ID NOS: 2159, 2043, 2104, 2402, and 2313.

The specific binding site of the IL-7Rα subunit for these IL-7Rα ligands can be characterized using competitive binding assays as described, for example, in Example 39.

Ligands provided by the present disclosure including IL-2Rβ ligands, IL-7Rα ligands, Rγc ligands, IL-2Rβγc ligands, IL-7Rαγc ligands, and dual receptor binding ligands can comprise one or more flanking amino acids bound to the N-terminus and/or to the C-terminus of the ligand.

The flanking amino acids can separate the portion of the ligand that interacts with IL-2R or IL-7R from other portions of the ligand and/or dual receptor binding ligand.

A ligand can comprise flanking amino acids such as, for example, from 1 to 20 amino acids, from 1 to 10 amino acids, such as from 1 to 8 amino acids, from 2 to 6 amino acids, or from 2 to 4 amino acids bound to the N-terminus and/or the C-terminus of the ligand.

Flanking amino acids can comprise any suitable naturally occurring or non-naturally occurring amino acids.

Flanking amino acids can be selected from serine and flexible amino acids such as serine.

A ligand can comprise flanking amino acids such as, for example, terminal glycine groups on the N-terminus and/or the C-terminus of the respective ligand. For example, a ligand can comprise flanking amino acids such as glycines such as from 1 to 10 flanking glycines (SEQ ID NO: 9619), from 1 to 8 (SEQ ID NO: 9620), from 1 to 6 (SEQ ID NO: 9621), or from 1 to 4 flanking glycines (SEQ ID NO: 9615). For example, an IL-2Rβ ligand, an IL-7Rα ligand, an Rγc ligand, an IL-2Rβγc ligand, an IL-7Rαγc ligand, or a dual receptor binding ligand can independently comprise flanking amino acids such as 1, 2, 3, or 4 terminal glycine groups.

A ligand provided by the present disclosure can comprise, for example, an amino acid substitution such as from 1 to 10 amino acid substitutions, from 1 to 8, from 1 to 6, from 1 to 4, such as 1, 2, 3, 4, 5, 6, 7, 8, 9, or 10 amino acid substitutions. An amino acid substitution can be a conservative amino acid substitution.

A ligand can comprise a truncated amino acid sequence.

A truncated amino acid sequence refers to an amino acid sequence which does not include one or more of the terminal amino acids. For example, in a truncated peptide one or more amino acids is removed from the N-terminus, the C-terminus or both the N-terminus and the C-terminus. Removing one or more amino acids from the N-terminus and/or the C-terminus of an amino acid sequence provided by the present disclosure can result in improved properties. Thus, ligands such as IL-2Rβ ligands, Rγc ligands, and IL-7Rα ligands provided by the present disclosure include truncated IL-7Rα ligands, truncated Rγc ligands, and truncated IL-2Rβ ligands.

Examples of truncated IL-2Rβ ligands based on SEQ ID NO: 9301 include:

```
                                    SEQ ID NO: 9301
G G W Y P C W M A Q L G E L C D L D G G

SEQ ID NO: 9302
  G W Y P C W M A Q L G E L C D L D G G

SEQ ID NO: 9303
    W Y P C W M A Q L G E L C D L D G G

SEQ ID NO: 9304
      Y P C W M A Q L G E L C D L D G G

SEQ ID NO: 9305
        P C W M A Q L G E L C D L D G G

SEQ ID NO: 9306
          C W M A Q L G E L C D L D G G

SEQ ID NO: 9307
G G W Y P C W M A Q L G E L C D L D G

SEQ ID NO: 9308
G G W Y P C W M A Q L G E L C D L D

SEQ ID NO: 9309
G G W Y P C W M A Q L G E L C D L

SEQ ID NO: 9310
G G W Y P C W M A Q L G E L C D

SEQ ID NO: 9311
G G W Y P C W M A Q L G E L C
```

GWYPCWMAQLGELCDLDG SEQ ID NO: 9312

WYPCWMAQLGELCDLDG SEQ ID NO: 9313

WYPCWMAQLGELCDLD SEQ ID NO: 395

YPCWMAQLGELCDL SEQ ID NO: 9314

PCWMAQLGELCDL SEQ ID NO: 9315

Examples of truncated IL-7Rα ligands based on SEQ ID NO: 9320 include:

VHRIPWCTLDPGGLQCAWLRQMGG SEQ ID NO: 9320

VHRIPWCTLDPGGLQCAWLRQM SEQ ID NO: 2407

VHRIPWCTLDPGGLQCAWLRQ SEQ ID NO: 9321

VHRIPWCTLDPGGLQCAWLR SEQ ID NO: 9322

VHRIPWCTLDPGGLQCAWL SEQ ID NO: 9323

VHRIPWCTLDPGGLQCAW SEQ ID NO: 9324

VHRIPWCTLDPGGLQCA SEQ ID NO: 9325

VHRIPWCTLDPGGLQC SEQ ID NO: 9326

HRIPWCTLDPGGLQCAWLRQMGG SEQ ID NO: 9327

RIPWCTLDPGGLQCAWLRQMGG SEQ ID NO: 9328

IPWCTLDPGGLQCAWLRQMGG SEQ ID NO: 9329

PWCTLDPGGLQCAWLRQMGG SEQ ID NO: 9330

WCTLDPGGLQCAWLRQMGG SEQ ID NO: 9331

CTLDPGGLQCAWLRQMGG SEQ ID NO: 9332

Examples of truncated Rγc ligands based on SEQ ID NO: 9340 include:

GGVVCQDWEGVELCWQGG SEQ ID NO: 9340

GVVCQDWEGVELCWQGG SEQ ID NO: 9341

VVCQDWEGVELCWQGG SEQ ID NO: 9342

VCQDWEGVELCWQGG SEQ ID NO: 9343

CQDWEGVELCWQGG SEQ ID NO: 9344

GGVVCQDWEGVELCWQG SEQ ID NO: 9345

GGVVCQDWEGVELCWQ SEQ ID NO: 9346

GGVVCQDWEGVELCW SEQ ID NO: 9347

GGVVCQDWEGVELC SEQ ID NO: 9348

GVVCQDWEGVELCWQG SEQ ID NO: 9349

VVCQDWEGVELCWQ SEQ ID NO: 1204

VCQDWEGVELCWQ SEQ ID NO: 9350

VCQDWEGVELCW SEQ ID NO: 9351

CQDWEGVELCW SEQ ID NO: 9352

CQDWEGVELC SEQ ID NO: 9353

Figure 32:
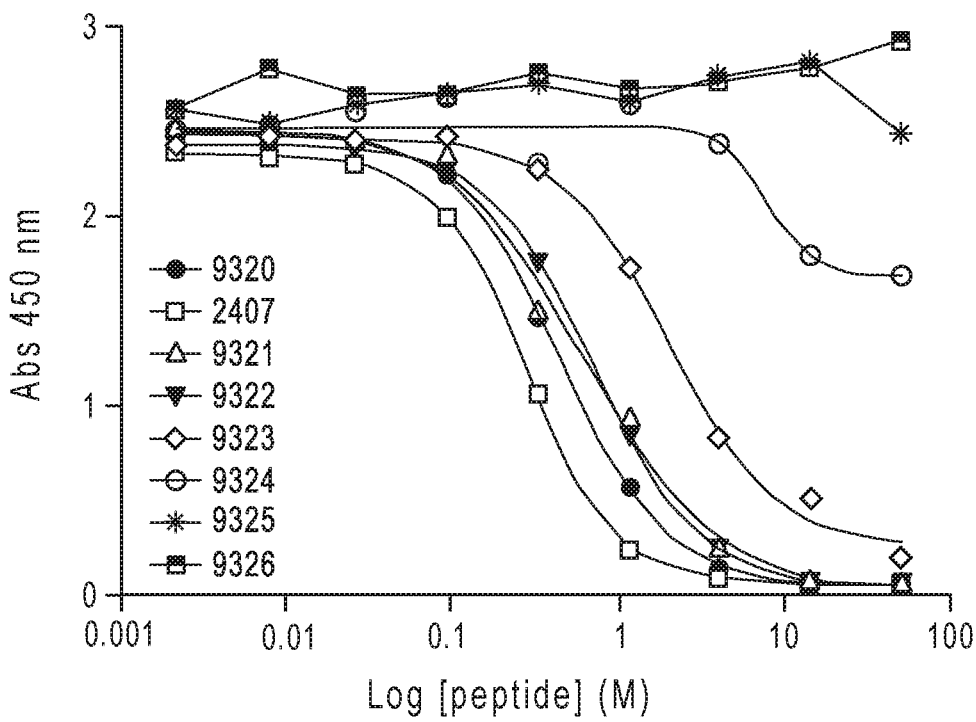
FIG. 32 shows the normalized ELISA signal for competitive binding of the NA-HRP complexes of various C-terminal truncated and biotinylated IL-7Rα ligands based on SEQ ID NO: 2407 to the IL-7Rα subunit.
Figure 33:
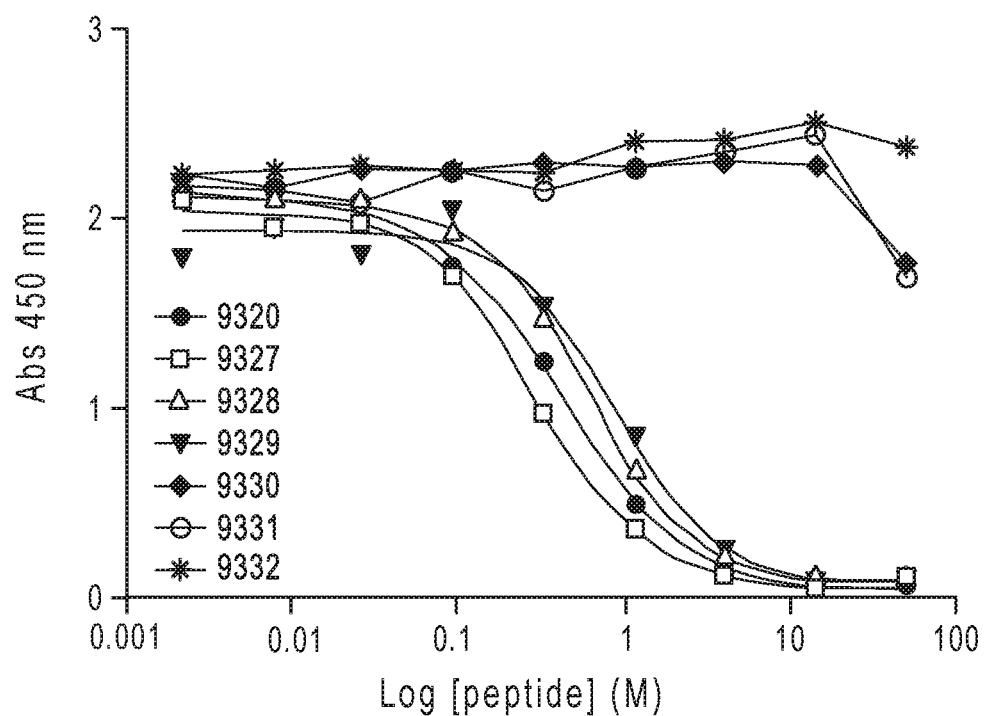
FIG. 33 shows the normalized ELISA signal for competitive binding of the NA-HRP complexes of various N-terminal truncated and biotinylated IL-7Rα ligands based on SEQ ID NO: 2407 to the IL-7Rα subunit.

The results of ELISA competition assays with a truncated IL-2Rβ ligands having SEQ ID NOS: 2407 and 9320-9326 based on the IL-2Rβ ligand having SEQ ID NO: 9320 and a biotinylated peptide::NA-HRP complex are shown in FIG. 32 for the C-terminus truncations and in FIG. 33 for the N-terminus truncations.

An IL-2Rβ ligand provided by the present disclosure can have greater than 60%, greater than 70%, greater than 75%, greater than 80%, greater than 85%, greater than 90%, or greater than 95% sequence similarity to any one of SEQ ID NOS: 1-572, 575-655, 661-891, 900-926, 930-937, and 9301-9315. An IL-2Rβ ligand provided by the present disclosure can have greater than 60%, greater than 70%, greater than 75%, greater than 80%, greater than 85%, greater than 90%, or greater than 95% sequence similarity to SEQ ID NO: 395.

An IL-7Rα ligand provided by the present disclosure can have greater than 60%, greater than 70%, greater than 75%, greater than 80%, greater than 85%, greater than 90%, or greater than 95% sequence similarity to any one of SEQ ID NOS: 2001-2410, 2601, 2602, and 9320-9332. An IL-7Rα ligand provided by the present disclosure can have greater than 60%, greater than 70%, greater than 75%, greater than 80%, greater than 85%, greater than 90%, or greater than 95% sequence similarity to SEQ ID NO: 2407.

An Rγc ligand provided by the present disclosure can have greater than 60%, greater than 70%, greater than 75%, greater than 80%, greater than 85%, greater than 90%, or greater than 95% sequence similarity to any one of SEQ ID NOS: 1001-1215, 1601-1613, and 9340-9353. An Rγc ligand provided by the present disclosure can have greater than 60%, greater than 70%, greater than 75%, greater than 80%, greater than 85%, greater than 90%, or greater than 95% sequence similarity to SEQ ID NO: 1204.

Ligands provided by the present disclosure can comprise an acetyl terminal group on the N-terminus and a carboxamide group on the C-terminus.

Each of an IL-20 ligand, an IL-7Rα ligand and an Rγc ligand can independently be covalently bound to a ligand linker through the N-terminus or through the C-terminus of the ligand. For example, in an IL-7Rαγc ligand, an IL-7Rα ligand can be bound to the ligand linker through the N-terminus and an Rγc ligand can be bound to a ligand linker through the N-terminus; an IL-7Rα ligand can be bound to a ligand linker through the N-terminus and an Rγc ligand can be bound to the ligand linker through the C-terminus; an IL-7Rα ligand can be bound to the ligand linker through the C-terminus and an Rγc ligand can be bound to the ligand linker through the N-terminus; or an IL-7Rα ligand can be bound to the ligand linker through the C-terminus and an Rγc ligand can be bound to the linker through the C-terminus.

Examples of IL-2R γc ligands having various orientations of the IL-2Rβ and Rγc ligands are shown in FIG. 1. As shown in FIG. 1, IL-2Rβγc ligands having various C/N orientations of the IL-2Rα ligand and the Rγc ligand can be synthesized using click chemistry. The triazole linkage is a schematic representation of a synthetic IL-2Rβγc ligand linker, which can comprise various chemical moieties and can have various lengths and properties. Examples of certain IL-2Rβγc ligand linkers are shown in FIGS. 19A-19C.

Figure 26:
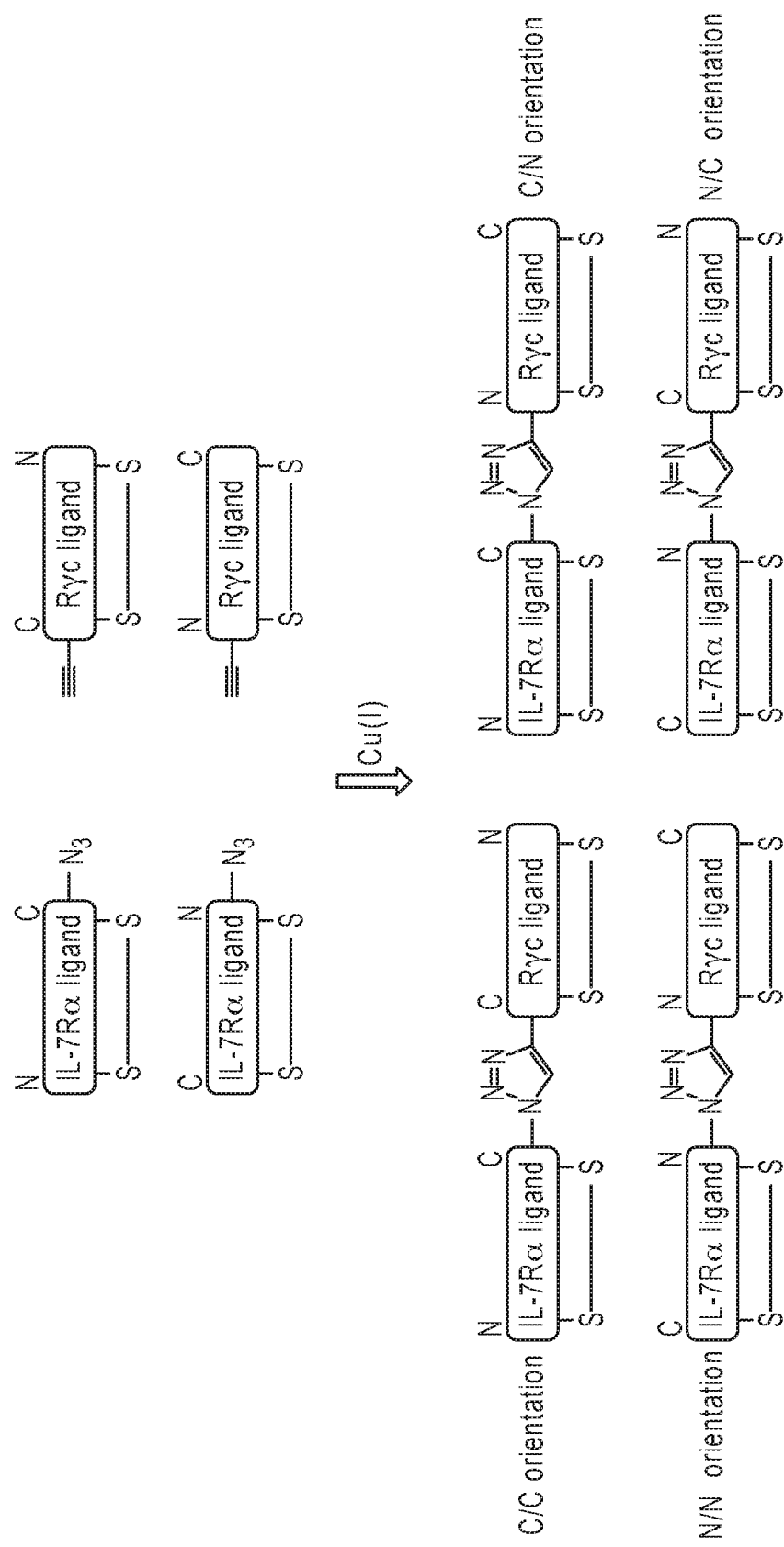
FIG. 26 shows examples of IL-7Rαγc ligands in which the individual IL-7Rα and Rγc ligands are attached via their respective N- and C-termini in the four possible orientations: C-to-N, C-to-C, N-to-C, or N-to-N.

Examples of IL-7Rαγc ligands having various orientations of the IL-7Rα and Rγc ligands are shown in FIG. 26. As shown in FIG. 26, IL-7Rαγc ligands having various C/N orientations of an IL-7Rα ligand and an Rγc ligand can be synthesized using click chemistry. The triazole linkage is a schematic representation of a synthetic IL-7Rαγc ligand linker, which can comprise various chemical moieties and can have various lengths and properties. Examples of certain IL-7Rαγc ligand linkers are shown in FIG. 38.

A ligand linker can be configured to facilitate binding of an IL-2Rβ ligand, an IL-7Rα ligand, an Rγc ligand, and a dual receptor binding compound to IL-2R and/or IL-7R. For example, an IL-7Rαγc ligand linker can be configured to facilitate activation of IL-7R by the IL-7Rαγc ligand. For example, ligand linkers of a dual IL-2R/IL-7R binding ligand can be configured to facilitate activation of IL-2R and IL-7R.

A ligand linker can have a length, for example, from 2 Å to 100 Å, from 2 Å to 80 Å, from 2 Å to 60 Å, from 2 Å to 40 Å, from 2 Å to 20 Å, from 4 Å to 18 Å, from 6 Å to 16 Å, or from 8 Å to 14 Å. A ligand linker can have a length, for example, less than 100 Å, less than 80 Å, less than 60 Å, less than 40 Å, less than 20 Å, less than 15 Å, or less than 10 Å.

A ligand linker can comprise a backbone having, for example, from 2 to 50 bonds, from 2 to 45 bonds, from 2 to 40 bonds, from 2 to 35 bonds, from 2 to 30 bonds, from 2 to 25 bonds, from 2 to 20 bonds, from 4 to 18 bonds, from 6 to 16 bonds, or from 8 to 14 bonds. A ligand linker can comprise a backbone having, for example, less than 50 bonds, less than 40 bonds, less than 30 bonds, less than 20 bonds, or less than 10 bonds.

A ligand linker provided by the present disclosure can comprise a peptidyl ligand or a synthetic linker.

A ligand linker provided by the present disclosure can comprise a peptidyl ligand linker.

A peptidyl ligand linker can comprise, for example, from 2 to 100 amino acids, from 2 to 80 amino acids, from 2 to 60 amino acids, from 2 to 40 amino acids, from 2 to 20 amino acids, from 5 to 10 amino acids, or from 2 to 5 amino acids. A peptidyl ligand linker can comprise, for example, less than 100 amino acids, less than 80 amino acids, less than 40 amino acids, less than 20 amino acids, less than 15 amino acids, less than 10 amino acids, or less than 5 amino acids. Amino acids forming a peptidyl ligand linker can comprise naturally occurring amino acids and/or non-naturally occurring amino acids.

A peptidyl ligand linker can comprise, for example, flexible amino acids such as glycine. Flexible linkers can include small, non-polar amino acids such as glycine or polar amino acids. The small size of these amino acids provides flexibility and allows for mobility of the connecting functional domains. Incorporation of serine or threonine can maintain the stability of the linker in aqueous solutions by forming hydrogen bonds with water molecules, and thereby reduces unfavorable interactions between the linker and protein moieties. Amino acids such as lysine and glutamic acid can be included to improve solubility. The length of a peptidyl ligand linker can be selected to provide a suitable separation between the adjoining ligands to favor a desired interaction with IL-2R and/or IL-7R such as enhancing agonist activity. A peptidyl ligand linker can be a flexible linker such as a linker having an amino acid sequence of any one of SEQ ID NOS: 9380-9407.

A peptidyl ligand linker can be a rigid linker such as a linker having an amino acid sequence of any one of SEQ ID NOS: 9420-9428.

Ligands comprising a peptidyl ligand linker can be synthesized using non-recombinant methods such as using the solid phase synthesis as described in Example 1 or can be synthesized using recombinant DNA technology.

A ligand linker can comprise a synthetic chemical ligand linker. A chemical-synthetic ligand linker refers to a linker that is synthesized using chemical methods and can include amino acids or may not include amino acids. A synthetic chemical ligand linker can comprise a triazole moiety.

A synthetic chemical ligand linker can have the structure, for example, of Formula (L1)-(L17) as shown in Table 1.

TABLE 1

Synthetic chemical ligand linkers.

| Formula No. | Chemical Structure |
|---|---|
| (L1) | 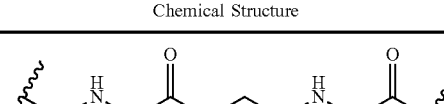 |
| (L2) |  <br> n = 2 |

TABLE 1-continued
Synthetic chemical ligand linkers.
| Formula No. | Chemical Structure |
|---|---|
| (L3) | 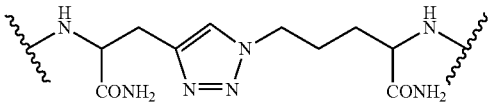 [SMILES: *NC(CCCn1cc(CC(N*)C(N)=O)nn1)C(N)=O] |
| (L4) | 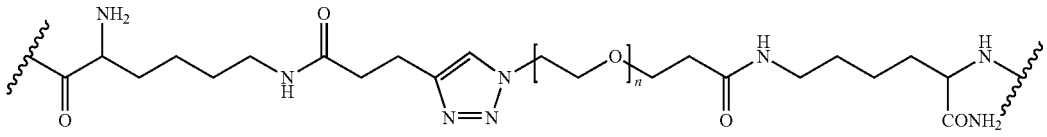<br>n = 2 |
| (L5) | 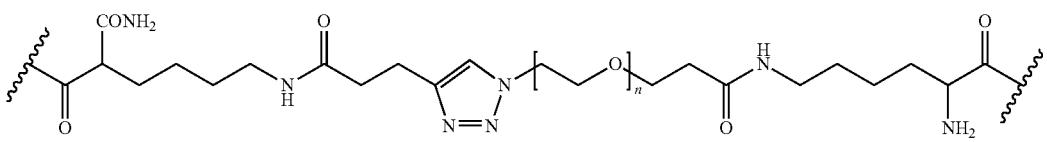<br>n = 2 |
| (L6) | 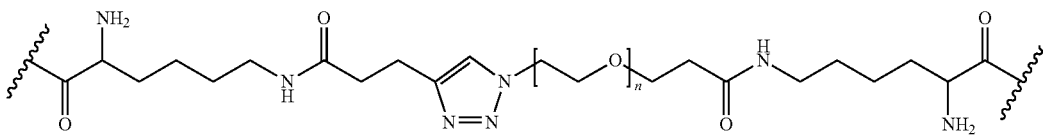<br>N = 2 |
| (L7) | 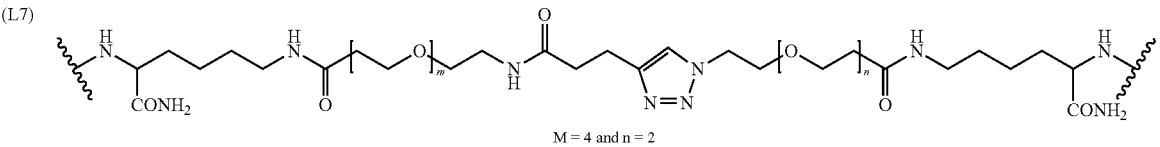<br>M = 4 and n = 2 |
| (L8) | 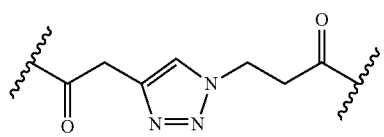 [SMILES: *C(=O)CCn1cc(CC(*)=O)nn1] |
| (L9) | 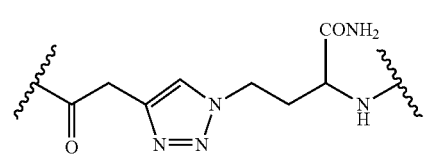 [SMILES: *NC(CCn1cc(CC(*)=O)nn1)C(N)=O] |
| (L10) | 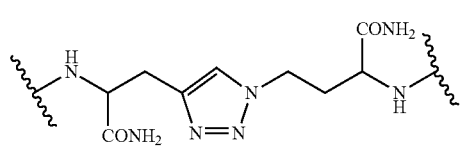 [SMILES: *NC(CCn1cc(CC(N*)C(N)=O)nn1)C(N)=O] |
| (L11) | 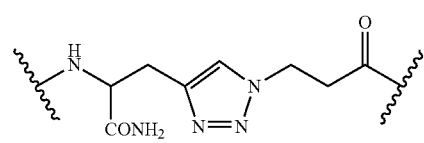 [SMILES: *NC(Cc1cn(CCC(*)=O)nn1)C(N)=O] |

TABLE 1-continued

Synthetic chemical ligand linkers.

| Formula No. | Chemical Structure |
|---|---|
| (L12) | m = 2, n = 1 |
| (L13) | m = 2, n = 4 |
| (L14) | 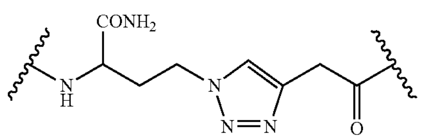 [SMILES: *NC(CCn1cc(CC(*)=O)nn1)C(N)=O] |
| (L15) | 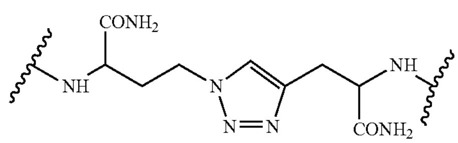 [SMILES: *NC(CCn1cc(CC(N*)C(N)=O)nn1)C(N)=O] |
| (L16) | 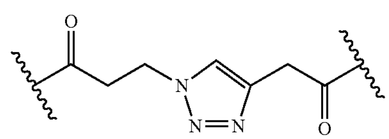 [SMILES: *C(=O)CCn1cc(CC(*)=O)nn1] |
| (L17) | 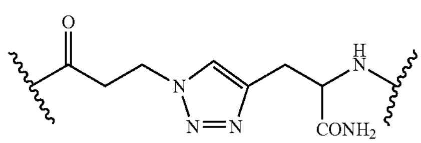 [SMILES: *NC(Cc1cn(CCC(*)=O)nn1)C(N)=O] |

In ligand linkers (L2), (L4)-(L7), (L12), and L13), m and/or n can be an integer, for example, from 1 to 10.

A chemical-synthetic ligand linker can be synthesized using click chemistry to provide ligands having various C/N orientations of the IL-2Rβ, IL-7Rα, and Rγc ligands. C/N orientation refers to the terminus of the IL-2Rβ, IL-7Rα and Rγc ligands which are bonded to the ligand linker. For example, for an IL-7Rαγc ligand having a C/N orientation, the C-terminus of the IL-7Rα ligand is bonded to the IL-ligand linker, and the N-terminus of the Rγc ligand is bonded to the ligand linker. As another example, for an IL-7Rαγc ligand having an N/C orientation, the N-terminus of the IL-7Rα ligand is bonded to the ligand linker, and the C-terminus of the Rγc ligand is bonded to the ligand linker.

An example of a method for preparing an IL-2Rβγc ligand having a synthetic ligand linker is described in Example 1.

An example of a method for preparing an IL-7Rαγc ligand having a synthetic ligand linker is described in Example 27.

IL-2Rβ ligands, IL-7Rα ligands, Rγc ligands, IL-2Rβγc ligands, IL-7Rαγc ligands, and unbranched dual receptor ligands can be prepared using standard solid phase peptide synthesis and Fmoc-protected amino acids. A swollen resin can be treated with either an activated solution of Fmoc-propargyl glycine or 2-(Fmoc-NH)-azido-pentanoic acid to provide the corresponding Fmoc-protected resin. The alkyne-containing moiety and the azide-containing moiety can be configured to have, for example, a desired length, rigidity/flexibility, polarity, lipophilicity, and/or steric property. The protected resin can be subjected to repeated cycles of Fmoc-amino acid couplings with HATU activation and Fmoc removal to synthesize the respective IL-2Rβ ligand, IL-7Rα ligand, Rγc ligand, IL-2Rβγc ligand, IL-7Rαγc ligand and unbranched dual receptor ligand. After Fmoc removal from the final amino acid of the IL-2Rβ ligand, IL-7Rα ligand, Rγc ligand, IL-2Rβγc ligand, IL-7Rαγc ligand and unbranched dual receptor ligand and acylation of terminal amine groups, the ligands can be cleaved from the resin and purified.

The alkyne-containing moiety and azide-containing moiety can be reacted, for example, in the presence of $CuSO_4$ and a metal chelator to provide a ligand comprising a synthetic chemical ligand linker. The reacted alkyne-containing moiety and azide-containing moiety form the chemical ligand linker. For example, referring to Tables 1-3, an alkyne-containing moiety of Formula (AL) in Table 2 can be reacted with an azide-containing moiety of Formula (AZ) in Table 3 to provide a synthetic ligand linker of Formula (L) in Table 1.

Using this click-chemistry method, ligands comprising IL-2Rβ, IL-7Rα and/or Rγc ligands having differing N-terminal and C-terminal orientations and different ligand linker lengths can be synthesized.

Examples of alkyne-containing moieties are provided in Table 2 and examples of azide-containing moieties are provided in Table 3.

TABLE 2

Examples of alkyne-containing moieties.

| Formula No. | Chemical Structure |
|---|---|
| (AL1) | 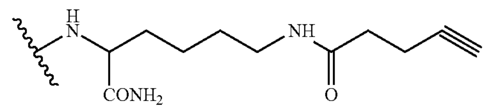 [SMILES: *NC(CCCCNC(=O)CCC#C)C(N)=O] |
| (AL2) | 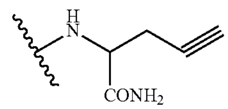 |
| (AL3) | 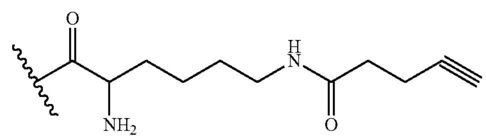 [SMILES: *C(=O)C(N)CCCCNC(=O)CCC#C] |
| (AL4) | 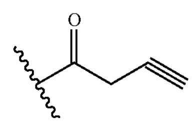 [SMILES: *C(=O)CC#C] |
| (AL5) | n = 4 |
| (AL6) | m = 2 and n = 1 |
| (AL7) | m = 2 and n = 4 |
| (AL8) | m = 1 to 10, and n = 1 to 10 |

TABLE 2-continued

Examples of alkyne-containing moieties.

| Formula No. | Chemical Structure |
|---|---|
| (AL9) | 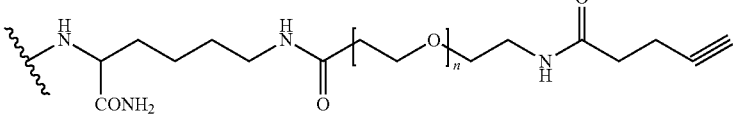<br>m = 1 to 10, and n = 1 to 10 |

TABLE 3

Examples of azide-containing moieties.

| Formula No. | Chemical Structure |
|---|---|
| (AZ1) | 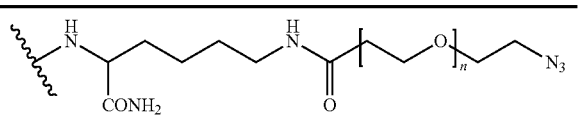<br>n = 2 |
| (AZ2) | 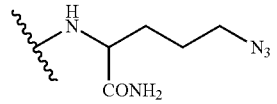 |
| (AZ3) | 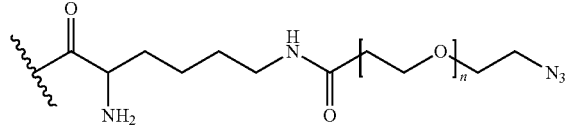<br>n = 1 or 2 |
| (AZ4) | 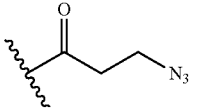 [SMILES: *C(=O)CCN=[N+]=[N-]] |
| (AZ5) | 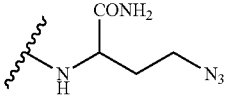 |

A ligand provided by the present disclosure can comprise N- and/or C-terminal modifications to prevent or minimize degradation by aminopeptidases and carboxypeptidases. Examples of terminal groups include an acetyl group on the N-terminus and a carboxamide group on the C-terminus.

An IL-2Rβγc ligand can comprise an IL-2Rβ ligand having an amino acid sequence selected from any one of SEQ ID NOS: 1-565, a substituted amino acid sequence of any one of SEQ ID NOS: 1-565, a truncated amino acid sequence of any one of SEQ ID NOS: 1-565, an amino acid sequence of any one of SEQ ID NOS: 1-565 having from 1 to 5 flanking glycines (SEQ ID NO: 9616) on the N-terminus and/or the C-terminus, an amino acid sequence having greater than 60% sequence similarity to any one of SEQ ID NOS: 1-565, or a combination of any of the foregoing; and an Rγc ligand having an amino acid sequence selected from any one of SEQ ID NOS: 1001-1215, a substituted amino acid sequence of any one of SEQ ID NOS: 1001-1215, a truncated amino acid sequence of any one of SEQ ID NOS: 1001-1215, an amino acid sequence of any one of SEQ ID NOS: 1001-1215 having from 1 to 5 flanking glycines (SEQ ID NO: 9616) on the N-terminus and/or the C-terminus, an amino acid sequence having greater than 60% sequence similarity to any one of SEQ ID NOS: 1001-1215, or a combination of any of the foregoing.

An IL-2Rβγc ligand can comprise an IL-2Rβ ligand having an amino acid sequence of SEQ ID NO: 395, a substituted amino acid sequence of SEQ ID NO: 395, a truncated amino acid sequence of SEQ ID NO: 395, an amino acid sequence of SEQ ID NO: 395 having from 1 to 5 flanking glycines (SEQ ID NO: 9616) on the N-terminus and/or the C-terminus, an amino acid sequence having greater than 60% sequence similarity to SEQ ID NO: 395, or a combination of any of the foregoing; and an Rγc ligand having an amino acid sequence selected from any one of SEQ ID NO: 1204, a substituted amino acid sequence of SEQ ID NO: 1204, a truncated amino acid sequence of SEQ ID NO: 1204, an amino acid sequence of SEQ ID NO: 1204 having from 1 to 5 flanking glycines (SEQ ID NO: 9616) on the N-terminus and/or the C-terminus, an amino acid sequence having greater than 60% sequence similarity to SEQ ID NO: 1204, or a combination of any of the foregoing.

An IL-2Rβγc ligand can comprise an amino acid sequence selected from anyone of SEQ ID NOS: 4001-4007, a substituted amino acid sequence of any one of SEQ ID NOS: 4001-4007, a truncated amino acid sequence of any one of SEQ ID NOS: 4001-4007, an amino acid sequence of any one of SEQ ID NOS: 4001-4007 having from 1 to 5 flanking glycines (SEQ ID NO: 9616) on the N-terminus and/or the C-terminus, an amino acid sequence having greater than 60% sequence similarity to any one of SEQ ID NOS: 4001-4007, or a combination of any of the foregoing.

```
                                      SEQ ID NO: 4001
-WYPCWMAQLGELCDLDGGGGSGGVVCQDWEGVELCWQ-
                                      SEQ ID NO: 4002
-GWYPCWMAQLGELCDLDGGGGSGGVVCQDWEGVELCWQG-
                                      SEQ ID NO: 4003
-GGWYPCWMAQLGELCDLDGGGGSGGVVCQDWEGVELCWQG-
                                      SEQ ID NO: 4004
-GWYPCWMAQLGELCDLDGGGGSGGVVCQDWEGVELCWQGG-
                                      SEQ ID NO: 4005
-GGWYPCWMAQLGELCDLDGGGGSGGVVCQDWEGVELCWQGG-
                                      SEQ ID NO: 4006
-WYPCWMAQLGELCDLD-X¹⁰⁰-VVCQDWEGVELCWQ-
                                      SEQ ID NO: 4007
-(X¹⁰¹)ₙ)-WYPCWMAQLGELCDLD-X¹⁰⁰-VVCQDWEGVELCWQ-(X¹⁰¹)ₙ-
```

In an IL-2Rβγc ligand having an amino acid sequence of any one of SEQ ID NOS: 4006-4007, $X^{100}$ can include from 1 to 20 amino acids. For example, $X^{100}$ can be selected from an amino acid sequence of any one of SEQ ID NOS: 9380-9407 and 9420-9428.

In IL-2Rβγc ligands having SEQ ID NO: 4007, each $X^{101}$ can independently comprise one or more flanking amino acid such as a glycine, where each n is independently an integer from 0 to 10 such as 1, 2, 3, 4, 5, 6, 7, 8, 9, or 10.

An IL-2Rβγc ligand having an amino acid sequence of any one of SEQ ID NOS: 4001-4007, the cysteines of the IL-2Rβ ligand can be bound together through a disulfide bond, and the cysteines of the Rγc ligand can be bound together through a disulfide bond. In certain IL-2Rβγc ligands, the cysteines of the IL-2Rβ ligand can be bound to the cysteines of the Rγc ligand.

An IL-2Rβγc ligand can have greater than 60%, greater than 70%, greater than 75%, greater than 80%, greater than 85%, greater than 90%, or greater than 95% sequence similarity to any one of SEQ ID NOS: 4001-4007.

An IL-2Rβγc ligand can comprise an amino acid sequence selected from any one of SEQ ID NOS: 4070-4085, a substituted amino acid sequence of any one of SEQ ID NOS: 4070-4085, a truncated amino acid sequence of any one of SEQ ID NOS: 4070-4085, an amino acid sequence of any one of SEQ ID NOS: 4070-4085 having from 1 to 5 flanking glycines (SEQ ID NO: 9616) on the N-terminus and/or the C-terminus, an amino acid sequence having greater than 60% sequence similarity to any one of SEQ ID NOS: 4070-4085, or a combination of any of the foregoing.

```
                                      SEQ ID NO: 4070
GGWYPCWIARVGELCDLEEGPVNRGGGGSGGVVCQDWEGVELCWQGG
                                      SEQ ID NO: 4071
GGAVEFYPCWLARIGELCDLVEPGGGGSGGVVCQDWEGVELCWQGG
                                      SEQ ID NO: 4072
GGWYPCWIARVGELCDMEGGGGSGGVVCQDWEGVELCWQGG
                                      SEQ ID NO: 4073
GGEWFHDCFLAKVGDLCDLFLWGGGGSGGVVCQDWEGVELCWQGG
                                      SEQ ID NO: 4074
GGRYVHDCFIAQVGDLCDLFLHGGGGSGGVVCQDWEGVELCWQGG
                                      SEQ ID NO: 4075
GGRSLVDCFLVKVGDLCDFFNWGGGGSGGVVCQDWEGVELCWQGG
                                      SEQ ID NO: 4076
GGWYPCWIARVGELCDLEGGGGSGGVVCQDWEGVELCWQGG
                                      SEQ ID NO: 4077
GGWYPCWLAQVGELCDLDGGGGSGGVVCQDWEGVELCWQGG
                                      SEQ ID NO: 4078
GGWYPCWIARVGELCDLEEGPVNRGGGGSGGGGSGGVVCQDWEGVEL
CWQGG
                                      SEQ ID NO: 4079
GGWYPCWIARVGELCDLEEGPVNRGGGGSGGGGSGGGGSGGVVCQDW
EGVELCWQGG
                                      SEQ ID NO: 4080
GGRYVHDCFIAQVGDLCDLFLHGGGGSGGGGSGGVVCQDWEGVELCW
QGG
                                      SEQ ID NO: 4081
GGRYVHDCFIAQVGDLCDLFLHGGGGSGGGGSGGGGSGGVVCQDWEG
VELCWQGG
                                      SEQ ID NO: 4082
GGRYVHDCFIAQVGDLCDLFLHGGGGSGGGGSGGGGSGGGGSGGVVC
QDWEGVELCWQGG
                                      SEQ ID NO: 4083
GGLVDCFKVKVGELCDLFGGGGSGGVVCQDWEGVELCWQGG
                                      SEQ ID NO: 4084
GGRYVHDCFIAQVGDLCDLFLHGGGSGGVVCQDWEGVELCWQGG
                                      SEQ ID NO: 4085
GGWYSCWMAQLGELCDLDGGGGSGGVVCQDWEGVELCWQGG
```

An IL-2Rβγc ligand having an amino acid sequence of any one of SEQ ID NOS: 4070-4085, the cysteines of the IL-2Rβ ligand can be bound together through a disulfide bond, and the cysteines of the Rγc ligand can be bound together through a disulfide bond. In certain IL-2Rβγc ligands, the cysteines of the IL-2Rβ ligand can be bound to the cysteines of the Rγc ligand.

An IL-2Rβγc ligand can have greater than 60%, greater than 70%, greater than 75%, greater than 80%, greater than 85%, greater than 90%, or greater than 95% sequence similarity to any one of SEQ ID NOS: 4070-4085.

In IL-2Rβγc ligand having SEQ ID NOS: 4070-4085 the ligand linker can be another ligand linker such as any of those disclosed herein.

An IL-2Rβγc ligand can have the structure of any one of SEQ ID NOS: 4090-4094.

```
                                              SEQ ID NO: 4090
Ac-WYPCWMAQLGELCDLDGGGGSGGVVCQDWEGVELCWQ-OH

SEQ ID NO: 4091
Ac-WYPCWMAQLGELCDLDGGGGSGGVVCQDWEGVALCWQ-OH

SEQ ID NO: 4092
Ac-WYPCW(Abu)AQLGELCDLDGGGGSGGVVCQDWEGVELCWQ-OH

SEQ ID NO: 4093
Ac-WYPCW(Abu)AQLGELCDLDGGGGSGGVVCQDWEGVALCWQ-OH

SEQ ID NO: 4094
Ac-WYPCWMAQLGELCDLDGGGGSGGVVCQDWEGVELCWQ-OH
```

An IL-2Rβγc ligand having the structure of any one of SEQ ID NOS: 4090-4094 can bind the hIL-2Rβ and hIL-2Rγc subunits with an IC50 of less than 100 μM.

An IL IL-2Rβγc ligand can have the structure of any one of SEQ ID NOS: 4095-4099.

```
                                              SEQ ID NO: 4095
Ac-GGELLVDCFKVKVGELCDLFFGGGGSGGVVCQDWEGVELCWQGG-OH

SEQ ID NO: 4096
Ac-GGRYVHDCFIAQVGDLCDLFLHGGGGSGGVVCQDWEGVELCWQGG-OH

SEQ ID NO: 4097
Ac-GGKWVHDCFLAKVGDVCDLFVVGGGGSGGVVCQDWEGVELCWQGG-OH

SEQ ID NO: 4098
Ac-GGRSLVDCFLVKVGDLCDFFNWGGGGSGGVVCQDWEGVELCWQGG-OH

SEQ ID NO: 4099
Ac-GGEWFHDCFLAKVGDLCDLFLWGGGGSGGVVCQDWEGVELCWQGG-OH
```

An IL-2Rβγc ligand having the structure of any one of SEQ ID NOS: 4095-4099 can bind to the hIL-2Rβ subunit, to the hIL-2Rγc subunit, to the cyno-IL-2Rβ subunit, and to the cyno-IL-2Rγc subunit with an IC50 of less than 100 μM.

An IL-7Rαγc ligand can comprise an IL-7Rα ligand having an amino acid sequence selected from any one of SEQ ID NOS: 2001-2410, a substituted amino acid sequence of any one of SEQ ID NOS: 2001-2410, a truncated amino acid sequence of any one of SEQ ID NOS: 2001-2410, an amino acid sequence of any one of SEQ ID NOS: 2001-2410 having from 1 to 5 flanking glycines (SEQ ID NO: 9616) on the N-terminus and/or the C-terminus, an amino acid sequence having greater than 60% sequence similarity to any one of SEQ ID NOS: 2001-2410, or a combination of any of the foregoing; and an Rγc ligand having an amino acid sequence selected from any one of SEQ ID NOS: 1001-1215, a substituted amino acid sequence of any one of SEQ ID NOS: 1001-1215, a truncated amino acid sequence of any one of SEQ ID NOS: 1001-1215, an amino acid sequence of any one of SEQ ID NOS: 1001-1215 having from 1 to 5 flanking glycines (SEQ ID NO: 9616) on the N-terminus and/or the C-terminus, an amino acid sequence having greater than 60% sequence similarity to any one of SEQ ID NOS: 1001-1215, or a combination of any of the foregoing.

An IL-7Rαγc ligand can comprise an IL-7Rα ligand having an amino acid sequence of SEQ ID NO: 2407, a substituted amino acid sequence of SEQ ID NO: 2407, a truncated amino acid sequence of SEQ ID NO: 2407, an amino acid sequence of SEQ ID NO: 2407 having from 1 to 5 flanking glycines (SEQ ID NO: 9616) on the N-terminus and/or the C-terminus, an amino acid sequence having greater than 60% sequence similarity to SEQ ID NO: 2407, or a combination of any of the foregoing; and an Rγc ligand having an amino acid sequence selected from any one of SEQ ID NO: 1204, a substituted amino acid sequence of SEQ ID NO: 1204, a truncated amino acid sequence of SEQ ID NO: 1204, an amino acid sequence of SEQ ID NO: 1204 having from 1 to 5 flanking glycines (SEQ ID NO: 9616) on the N-terminus and/or the C-terminus, an amino acid sequence having greater than 60% sequence similarity to SEQ ID NO: 1204, or a combination of any of the foregoing.

An IL-7Rαγc ligand can comprise an amino acid sequence selected from any one of SEQ ID NOS: 4021-4028, a substituted amino acid sequence of any one of SEQ ID NOS: 4021-4028, a truncated amino acid sequence of any one of SEQ ID NOS: 4021-4028, an amino acid sequence of any one of SEQ ID NOS: 4021-4028 having from 1 to 5 flanking glycines (SEQ ID NO: 9616) on the N-terminus and/or the C-terminus, an amino acid sequence having greater than 60% sequence similarity to any one of SEQ ID NOS: 4021-4028, or a combination of any of the foregoing.

```
                                              SEQ ID NO: 4021
-VHRIPWCTLDPGGLQCAWLRQMGGGGSGGVVCQDWEGVELCWQ-

SEQ ID NO: 4022
-VHRIPWCTLDPGGLQCAWLRQMGGGGSGGVVCQDWEGVELCWQG-

SEQ ID NO: 4023
-GVHRIPWCTLDPGGLQCAWLRQMGGGGSGGVVCQDWEGVELCWQ-

SEQ ID NO: 4024
-GVHRIPWCTLDPGGLQCAWLRQMGGGGSGGVVCQDWEGVELCWQG-

SEQ ID NO: 4025
-VHRIPWCTLDPGGLQCAWLRQMGGGGSGGVVCQDWEGVELCWQG-

SEQ ID NO: 4026
-GGVHRIPWCTLDPGGLQCAWLRQMGGGGSGGVVCQDWEGVELCWQGG-

SEQ ID NO: 4027
-VHRIPWCTLDPGGLQCAWLRQM-X^{100}-VVCQDWEGVELCWQ-

SEQ ID NO: 4028
-(X^{101})_n-VHRIPWCTLDPGGLQCAWLRQM-X^{100}-
VVCQDWEGVELCWQ-(X^{101})_n-
```

In an IL-7Rαγc ligand having an amino acid sequence of any one of SEQ ID NOS: 4027-4028, $X^{100}$ can include from 1 to 40 amino acids. For example, $X^{100}$ can be selected from an amino acid sequence of any one of SEQ ID NOS: 9380-9407 and 9420-9428.

In SEQ ID NOS: 4027-4028, each $X^{101}$ can independently comprise a flanking amino acid such as one or more glycines, where each n is independently an integer from 0 to 10, such as 1, 2, 3, 4, 5, 6, 7, 8, 9, and 10.

An IL-7Rαγc ligand having an amino acid sequence of anyone of SEQ ID NOS: 4021-4028, the cysteines of the IL-7Rα ligand can be bound together through a disulfide bond, and the cysteines of the Rγc ligand can be bound together through a disulfide bond. In certain IL-7Rαγc ligands, the cysteines of the IL-7Rα ligand can be bound to the cysteines of the Rγc ligand.

An IL-7Rαγc ligand can have greater than 60%, greater than 70%, greater than 75%, greater than 80%, greater than 85%, greater than 90%, or greater than 95% sequence similarity to any one of SEQ ID NOS: 4021-4028.

A dual IL-2R/IL-7R binding ligand provided by the present disclosure can comprise:

an IL-2Rβ ligand having an amino acid sequence selected from any one of SEQ ID NOS: 1-572, 575-655, 661-891, 900-926, 930-937, and 9301-9315, a substituted amino acid sequence of any one of SEQ ID NOS: 1-572, 575-655, 661-891, 900-926, 930-937, and 9301-9315, a truncated amino acid sequence of any one of SEQ ID NOS: 1-572, 575-655, 661-891, 900-926, 930-937, and 9301-9315, an amino acid sequence of any one of SEQ ID NOS: 1-572, 575-655, 661-891, 900-926, 930-937, and 9301-9315 having from 1 to 5 flanking glycines (SEQ ID NO: 9616) on the N-terminus and/or the C-terminus, an amino acid sequence having greater than 60% sequence similarity to any one of SEQ ID NOS: 1-572, 575-655, 661-891, 900-926, 930-937, and 9301-9315, or a combination of any of the foregoing; an IL-7Rα ligand having an amino acid sequence selected from any one of SEQ ID NOS: 2001-2410, 2601, 2602, and 9320-9332, a substituted amino acid sequence of any one of SEQ ID NOS: 2001-2410, 2601, 2602, and 9320-9332, a truncated amino acid sequence of any one of SEQ ID NOS: 2001-2410, 2601, 2602, and 9320-9332, an amino acid sequence of any one of SEQ ID NOS: 2001-2410, 2601, 2602, and 9320-9332 having from 1 to 5 flanking glycines (SEQ ID NO: 9616) on the N-terminus and/or the C-terminus, an amino acid sequence having greater than 60% sequence similarity to any one of SEQ ID NOS: 2001-2410, 2601, 2602, and 9320-9332, or a combination of any of the foregoing; and a Rγc ligand having an amino acid sequence selected from any one of SEQ ID NOS: 1001-1215, 1601-1613, and 9340-9353, a substituted amino acid sequence of any one of SEQ ID NOS: 1001-1215, 1601-1613, and 9340-9353, a truncated amino acid sequence of any one of SEQ ID NOS: 1001-1215, 1601-1613, and 9340-9353, an amino acid sequence of any one of SEQ ID NOS: 1001-1215, 1601-1613, and 9340-9353 having from 1 to 5 flanking glycines (SEQ ID NO: 9616) on the N-terminus and/or the C-terminus, an amino acid sequence having greater than 60% sequence similarity to any one of SEQ ID NOS: 1001-1215, 1601-1613, and 9340-9353, or a combination of any of the foregoing.

A dual IL-2R/IL-7R receptor binding ligand provided by the present disclosure can comprise, for example:

an IL-2Rβ ligand having an amino acid sequence of SEQ ID NO: 395, a substituted amino acid sequence of SEQ ID NO: 395, a truncated amino acid sequence of SEQ ID NO: 395, an amino acid sequence of SEQ ID NO: 395 having from 1 to 5 flanking glycines (SEQ ID NO: 9616) on the N-terminus and/or the C-terminus, an amino acid sequence having greater than 60% sequence similarity to SEQ ID NO: 395, or a combination of any of the foregoing;

an IL-7Rα ligand having an amino acid sequence of SEQ ID. NO: 2407, a substituted amino acid sequence of SEQ ID NO: 2407, a truncated amino acid sequence of SEQ ID NO: 2407, an amino acid sequence of SEQ ID NO: 2407 having from 1 to 5 flanking glycines (SEQ ID NO: 9616) on the N-terminus and/or the C-terminus, an amino acid sequence having greater than 60% sequence similarity to SEQ ID NO: 2407, or a combination of any of the foregoing; and an Rγc ligand having an amino acid sequence of SEQ ID NO: 1204, a substituted amino acid sequence of SEQ ID NO: 1204, a truncated amino acid sequence of SEQ ID NO: 1204, an amino acid sequence of SEQ ID NO: 1204 having from 1 to 5 flanking glycines (SEQ ID NO: 9616) on the N-terminus and/or the C-terminus, an amino acid sequence having greater than 60% sequence similarity to SEQ ID NO: 1204, or a combination of any of the foregoing.

A linear dual IL-2R/IL-7R receptor binding ligand can comprise, for example, an amino acid sequence selected from any one of SEQ ID NOS: 4041-4058, a substituted amino acid sequence of any one of SEQ ID NOS: 4041-4058, a truncated amino acid sequence of any one of SEQ ID NOS: 4041-4028, an amino acid sequence of any one of SEQ ID NOS: 4041-4058 having from 1 to 5 flanking glycines (SEQ ID NO: 9616) on the N-terminus and/or the C-terminus, an amino acid sequence having greater than 60% sequence similarity to any one of SEQ ID NOS: 4041-4058, or a combination of any of the foregoing.

```
                                      SEQ ID NO: 4041
VHRIPWCTLDPGGLQCAWLRQMGGGGSGGWYPCWMAQLGELCDLDGG

GGSGGVVCQDWEGVELCWQ

SEQ ID NO: 4042
VHRIPWCTLDPGGLQCAWLRQMGGGGSGGVVCQDWEGVELCWQGGGG

SGGWYPCWMAQLGELCDLD

SEQ ID NO: 4043
WYPCWMAQLGELCDLDGGGGSGGVVCQDWEGVELCWQGGGGSGGVHR

IPWCTLDPGGLQCAWLRQM

SEQ ID NO: 4044
WYPCWMAQLGELCDLDGGGGSGGVHRIPWCTLDPGGLQCAWLRQMGG

GGSGGVVCQDWEGVELCWQ

SEQ ID NO: 4045
VVCQDWEGVELCWQGGGGSGGVHRIPWCTLDPGGLQCAWLRQMGGGG

SGGWYPCWMAQLGELCDLD

SEQ ID NO: 4046
VVCQDWEGVELCWQGGGGSGGWYPCWMAQLGELCDLDGGGGSGGVHR

IPWCTLDPGGLQCAWLRQM

SEQ ID NO: 4047
VHRIPWCTLDPGGLQCAWLRQM-X$^{100}$-WYPCWMAQLGELCDLDGGGG

SGGVVCQDWEGVELCWQ

SEQ ID NO: 4048
VHRIPWCTLDPGGLQCAWLRQM-X$^{100}$-VVCQDWEGVELCWQGGGGSG

GWYPCWMAQLGELCDLD

SEQ ID NO: 4049
WYPCWMAQLGELCDLD-X$^{100}$-

VVCQDWEGVELCWQGGGGSGGVHRIPWCTLDPGGLQCAWLRQM

SEQ ID NO: 4050
WYPCWMAQLGELCDLD-X$^{100}$-VHRIPWCTLDPGGLQCAWLRQMGGGG

SGGVVCQDWEGVELCWQ

SEQ ID NO: 4051
VVCQDWEGVELCWQ-X$^{100}$-VHRIPWCTLDPGGLQCAWLRQMGGGGSG

GWYPCWMAQLGELCDLD

SEQ ID NO: 4052
VVCQDWEGVELCWQ-X$^{100}$-WYPCWMAQLGELCDLDGGGGSGGVHRIP

WCTLDPGGLQCAWLRQM

SEQ ID NO: 4053
-(X$^{101}$)$_n$-VHRIPWCTLDPGGLQCAWLRQM-X$^{100}$-

WYPCWMAQLGELCDLDGGGGSGGVVCQDWEGVELCWQ-(X$^{101}$)$_n$-

SEQ ID NO: 4054
-(X$^{101}$)$_n$-VHRIPWCTLDPGGLQCAWLRQM-X$^{100}$-

VVCQDWEGVELCWQGGGGSGGWYPCWMAQLGELCDLD-(X$^{101}$)$_n$-

SEQ ID NO: 4055
-(X$^{101}$)$_n$-WYPCWMAQLGELCDLD-X$^{100}$-VVCQDWEGVELCWQGGG

GSGGVHRIPWCTLDPGGLQCAWLRQM-(X$^{101}$)$_n$-
```

-continued

SEQ ID NO: 4056
-(X$^{101}$)$_n$)-WYPCWMAQLGELCDLD-X$^{100}$-VHRIPWCTLDPGGLQCA

WLRQMGGGGSGGVVCQDWEGVELCWQ-(X$^{101}$)$_n$)-

SEQ ID NO: 4057
-(X$^{101}$)$_n$)-VVCQDWEGVELCWQ-X$^{100}$-VHRIPWCTLDPGGLQCAWL

RQMGGGGSGGWYPCWMAQLGELCDLD-(X$^{101}$)$_n$)-

SEQ ID NO: 4058
-(X$^{101}$)$_n$)-VVCQDWEGVELCWQ-X$^{100}$-WYPCWMAQLGELCDLDGGG

GSGGVHRIPWCTLDPGGLQCAWLRQM-(X$^{101}$)$_n$)-

In a dual IL-2R/IL-7R binding ligand having an amino acid sequence of any one of SEQ ID NOS: 4047-4058, X$^{100}$ can include from 1 to 40 amino acids. For example, X$^{100}$ can be selected from an amino acid sequence of any one of SEQ ID NOS: 9380-9407 and 9420-9428.

In dual IL-2R/IL-7R binding ligands having SEQ ID NOS: 4047-4058, each X$^{101}$ can independently comprise a flanking amino acid such as a glycine, where each n is independently an integer from 1 to 5.

In a linear dual IL-2R/IL-7R binding ligand having an amino acid sequence of any one of SEQ ID NOS: 4041-4058, the cysteines of the IL-2Rβ ligand can be bound together through a disulfide bond, the cysteines of the IL-7Rα ligand can be bound together through a disulfide bond, and the cysteines of the Rγc ligand can be bound together through a disulfide bond. In certain dual IL-2R/IL-7R ligands, the cysteines of the IL-2Rβ ligand can be bound together through a disulfide bond, the cysteines of the IL-7Rα ligand can be bound to the cysteines of the Rγc ligand.

A dual IL-2R/IL-7R ligand can have greater than 60%, greater than 70%, greater than 75%, greater than 80%, greater than 85%, greater than 90%, or greater than 95% sequence similarity to any one of SEQ ID NOS: 4041-4058.

Tandem ligands provided by the present disclosure can comprise two or more IL-2Rβγc or two or more IL-7Rαγc ligands. The two or more IL-2Rβγc ligands or two or more IL-7Rαγc ligands can be bound together to form a linear or non-linear structure. For example, a tandem IL-2Rβγc ligand and/or a tandem IL-7Rαγc ligand can have the structure of Formula (22a) or Formula (22b):

DL-(-L$^{t1}$-DL-)$_{n1}$-L$^{t1}$-DL    (22a)

L$^{t2}${(-L$^{t1}$-DL-)$_{n2}$-L$^{t1}$-DL}$_p$    (22b)

where,
each DL can independently be a ligand selected from an IL-2Rβγc ligand and an IL-7Rαγc ligand;
L$^{t1}$ can be a divalent tandem linker;
L$^{t2}$ can be a p-valent tandem linker;
n1 can be an integer from 1 to 6;
n2 can be an integer from 0 to 6; and
p can be an integer from 3 to 8.

In tandem ligands of Formula (22a) and (22b), each IL-2Rβγc ligand can be the same and/or each IL-7Rαγc ligand can be the same.

In tandem ligands of Formula (22a) and (22b), at least one IL-2Rβγc ligand can be different than another IL-2Rβγc ligand and/or at least one IL-7Rαγc ligand can be different than another IL-7Rαγc ligand.

In tandem ligands of Formula (22a) and (22b), each ligand can independently be bound to a tandem linker through the N-terminus or through the C-terminus of the respective ligand.

In tandem ligands of Formula (22a) and (22b), each of the ligands can comprise one or more flanking amino acids.

A tandem linker, L$^{t1}$ and L$^{t2}$, can be a peptidyl tandem linker and can have, for example, from 1 to 50 amino acids, from 2 to 40 amino acids, or from 5 to 30 amino acids.

A tandem linker can comprise a chemical linker such as a triazole-containing linker provided by the present disclosure.

Each divalent tandem linker L$_{t1}$ can be the same as each of the other divalent tandem linkers, or at least one of the divalent tandem linkers can be different than another tandem linker.

In a tandem ligand of Formula (22a), n can be, for example, 1, 2, 3, 4, 5, or 6.

In a tandem ligand of Formula (22b), each n can independently be selected from 0, 1, 2, 3, 4, 5, or 6.

In a tandem ligand of Formula (22b), p can be, for example, 3, 4, 5, 6, 7, or 8.

A p-valent tandem linker can comprise any suitable polyfunctional chemical moiety. For example, tandem ligands of Formula (22a) and (22b) can have a molecular weight less than 10,000 Da, less than 6,000 Da, less than 2,000 Da, less than 1,000 Da, or less than 500 Da.

A dual receptor binding compound provided by the present disclosure can comprise an IL-2Rβγc ligand and an IL-7Rαγc ligand bound to a small chemical moiety or a dual IL-2R/IL-7R binding ligand bound to a small chemical moiety.

A small chemical moiety and can have a molecular weight, for example, less than 12,000 Da, less than 11,000 Da, less than 10,000 Da, less than 9,000 Da, less than 8,000 Da, less than 7,000 Da, less than 6,000 Da, less than 5,000 Da, less than 4,000 Da, less than 3,000 Da, less than 2,000 Da, or less than 1,000 Da. A small chemical moiety can have a molecular weight, for example, from 1,000 Da to 12,000 Da, from 2,000 Da, to 11,000 Da, from 3,000 Da, to 10,000 Da, or from 4,000 Da to 9,000 Da.

A ligand provided by the present disclosure can be bound to a naturally occurring protein or to a synthetic molecule to provide a dual receptor binding construct. Examples of suitable construct partners include polymers, proteins, Fc-fragments, immunoglobulins, immunoglobulin fragments, and antibodies.

A dual receptor binding construct can be configured to provide a desired pharmacokinetic property, to provide reduced immunogenicity, to target a specific cell population, and/or to provide enhanced therapeutic efficacy.

A dual receptor binding construct can be bound to the construct partner through a construct linker.

A dual receptor binding construct can comprise at least one IL-2Rβ ligand, at least one IL-7Rα ligand, and at least one Rγc ligand provided by the present disclosure and is capable of binding to both the IL-2R and the IL-7R with an IC$_{50}$ less than 100 μM, such as less than 10 μM, less than 1 μM, or less than 100 μM.

A dual receptor binding construct can comprise one or more IL-2Rβγc ligands and one or more IL-7Rαγc ligands bound to a construct partner. A dual receptor binding construct can comprise one or more dual receptor binding ligands such as one or more linear dual receptor binding ligands or one or more branched dual receptor binding ligands bound to a construct partner.

Each of the two or more ligands bound to a construct partner can be the same, or at least one of the ligands can be different than at least one of the other ligands bound to the construct partner. The ligands can differ, for example, with respect to the amino acid sequence of the IL-2Rβ ligand, the amino acid sequence of the IL-7Rα ligand, the amino acid sequence of the Rγc ligand, the amino acid sequence or the chemical structure of a ligand linker, and/or to the amino acid sequence of flanking amino acids.

Each of the ligands can independently be bound to a construct partner through a respective construct linker. Each of the respective construct linkers can be the same, or at least one of the construct linkers can be different than at least one other construct linker. The construct linkers can differ, for example, with respect to the length and/or to the chemical composition such as the amino acid sequence of the construct linker.

Each of the ligands can independently be bound to a construct partner through the N-terminus or through the C-terminus of the respective ligand.

A dual receptor binding construct can comprise a tandem ligand bound to a construct partner. A tandem ligand can be bound to the construct partner through a construct linker.

A dual receptor binding construct can comprise a single tandem ligand bound to a construct partner or two or more tandem ligands bound to a construct partner.

Each of the two or more tandem ligands bound to a construct partner can be the same, or at least one of the tandem ligands can be different than at least one of the other tandem ligands bound to the construct partner. The tandem ligands can differ, for example, with respect to the IL-2Rβ ligands, IL-7Rα ligands, the Rγc ligands, the ligand linkers, the tandem linkers, and/or the flanking amino acids.

Each of the tandem ligands can be bound to a construct partner through a respective construct linker. Each of the respective construct linkers can be the same, or at least one of the construct linkers can be different than at least one other construct linker. The construct linkers can differ, for example, with respect to the length and/or to the chemical composition.

Each of the tandem ligands can independently be bound to the construct partner through the N-terminus or the C-terminus of the respective tandem ligand.

A dual receptor binding construct can comprise at least one IL-2Rβ ligand, at least one IL-7Rα ligand and at least one Rγc ligand bound to a construct partner. Each of the at least one IL-2R ligand, at least one IL-7Rα ligand, and the at least one Rγc ligand can independently be bound to the construct partner through a construct linker.

A dual receptor binding construct can comprise, for example, at least one IL-2Rβγc ligand, at least one IL-7Rαγc ligand, at least one dual receptor binding ligand, at least one tandem ligand, at least one IL-2Rβ ligand, at least one IL-7Rα ligand, at least one Rγc ligand, providing that the dual receptor binding construct comprises at least one IL-2Rβ ligand, at least one IL-7Rα ligand, and at least one Rγc ligand.

A dual receptor binding construct can comprise one or more ligands bound to a side chain of a molecule such as a side chain of an amino acid forming a polymer or protein.

A dual receptor binding construct can comprise one or more ligands in which the one or more ligands is incorporated into the backbone of the polymer or polypeptide. For example, a dual receptor binding construct can comprise one or more IL-2Rβγc ligands and one or more IL-7Rαγc ligands in which the one or more IL-7Rαγc ligands are bound to an N-terminus of a polypeptide, bound to a C-terminus of a polypeptide, bound to an amino acid side chain of a polypeptide, and/or incorporated into the amino acid backbone of the polypeptide. For example, a dual receptor binding construct can comprise one or more dual receptor binding ligands in which the one or more dual receptor binding ligands is bound to an N-terminus of a polypeptide, bound to a C-terminus of a polypeptide, bound to an amino acid side chain of a polypeptide, and/or incorporated into the amino acid backbone of the polypeptide.

A dual receptor binding construct provided by the present disclosure can include a fusion protein.

Examples of suitable fusion protein partners include Fc-fragments, immunoglobulins such as IgG1, IgG2, and IgG4, immunoglobulin fragments such as IgG1, IgG2, and IgG4 fragments, naturally occurring proteins such as human serum albumin (HSA), antibodies, other human proteins and mutants and/or variants thereof, proteins, and polypeptides. A fusion protein partner can be a naturally occurring protein, a modified-naturally occurring protein, or a synthetic protein.

A fusion partner can be used to provide a desirable pharmacokinetic profile, for cell-targeting, for dual pharmacology, and/or for enhancing therapeutic efficacy.

For example, a dual receptor binding construct provided by the present disclosure can comprises one or more ligands fused to a protein that increases the circulating half-life of the ligand. Fusions of therapeutic proteins with IgG or the IgG-Fc chain can accomplish this by increasing the hydrodynamic radius of the protein, thus reducing renal clearance, and through Neonatal Fc Receptor (FcRn)-mediated recycling of the fusion protein, thus prolonging the circulating half-life. Other fusion proteins can be designed to tailor properties such as the pharmacokinetics, biodistribution, pharmacodynamics, pharmacology, cytotoxicity, selectivity, and/or targeting.

A dual receptor binding fusion protein provided by the present disclosure can comprise one or more IL-2Rβγc ligands and one or more IL-7Rαγc ligands bound to a fusion protein partner. A dual receptor binding fusion protein provided by the present disclosure can comprise one or more dual IL-2R/IL-7R binding ligands bound to a fusion protein partner. Each of the one or more ligands can be independently bound to a fusion protein partner through the N-terminus or through the C-terminus of the respective ligand. Each of the one or more ligands can be the same. At least one of the one or more ligands can be different than at least one other ligand. The amino acid sequence at the junction between a dual ligand and a fusion partner protein can be either a direct fusion of the two protein sequences or can be a fusion with an intervening peptidyl fusion linker. Peptidyl linkers can be included as spacers between a ligand and the fusion partner. Peptidyl linkers can promote proper protein folding and stability of the component protein and the one or more ligands, improve protein expression, and/or can enhance bioactivity of the ligand and/or the fusion partner.

Peptidyl construct linkers used in ligand fusion proteins can be designed to be unstructured flexible peptides. Peptidyl linkers can be, for example, rich in glycine and serine, such as repeats of a sequence such as, for example, an amino acid sequence of any one of SEQ ID NOS: 9380-9407. A flexible peptidyl linker with a fully extended β-strand conformation can have an end-to-end length, for example, of 3.5 Å per residue. Thus, a peptidyl linker of 5, 10, 15, or 10 residues can have a maximum fully extended length, for example, of 17.5 Å, 35 Å, 52.5 Å, 70 Å, 140 Å, or more than 140 Å, respectively.

Peptidyl construct linkers can be rigid linkers, such as linkers including proline and other amino acids such as alanine, lysine or glutamic acid. For example, a rigid linker can have an amino acid sequence of any one of SEQ ID NOS: 9420-9428. A peptidyl construct linker can facilitate providing an appropriate conformation and orientation of individual fusion protein moieties to facilitate the engagement of a ligand with the IL-2Rβ subunit, the IL-7Rα subunit, and/or Rγc subunit of IL-2R or IL-7R, facilitate binding of the ligand to IL-2R, facilitate binding of the ligand to IL-7R, enable fusion protein recycling, and/or prolong the circulating half-life of the ligand.

There are multiple options for the design and construction of a fusion protein comprising one or more ligands and which can be selected to obtain a ligand fusion protein having the desired biological activity and pharmaceutical characteristics. Design options include, for example, the IL-2Rβγc ligand including the selection of the IL-2Rβ ligand and the Rγc ligand; the IL-7Rαγc ligand including the selection of the IL-7Rα ligand and the Rγc ligand, and the ligand linker; in the case of a dual IL-2R-IL-7R binding ligand the IL-2Rβ ligand, the IL-7Rα ligand, the Rγc ligand, and the ligand linkers; the fusion partner protein binding moiety; the configuration of the fusion partner binding moiety in the fusion protein; the peptidyl linker binding ligand to the fusion partner; and the fusion partner protein.

In general, preparation of dual receptor binding fusion proteins provided by the present disclosure can be prepared using recognized recombinant DNA techniques involving, for example, polymerase chain amplification reactions (PCR), preparation of plasmid DNA, cleavage of DNA with restriction enzymes, preparation of oligonucleotides, ligation of DNA, isolation of mRNA, introduction of the DNA into a suitable cell, transformation or transfection of a host, and culturing of the host. Additionally, dual receptor binding fusion proteins can be isolated and purified using chaotropic agents and using well-known electrophoretic, centrifugation, and chromatographic methods.

Dual receptor binding fusion proteins provided by the present disclosure can comprise one or more small ubiquitin-related modifier (SUMO) proteins. Modification of cellular proteins by the ubiquitin-like modifier SUMO can regulate various cellular processes, such as nuclear transport, signal transduction, and stabilization of proteins. Once covalently attached to cellular targets, SUMO regulates protein/protein and protein/DNA interactions, as well as localizes and stabilizes the target protein.

For example, a ligand can be bound to a first linker, which is bound to a SUMO protein, which is further bound to a second linker binding the SUMO protein to a fusion partner such as an IgG or Fc-fragment. SUMO fusions can enhance expression, promote solubility, and/or facilitate optimized protein folding. Attachment of a highly stable structure such as that of ubiquitin or SUMO at the N-terminus or at the C-terminus of a fusion partner protein can increase the yield by increasing stability. The solubilizing effect of ubiquitin and ubiquitin-like proteins may also be explained in part by the outer hydrophilicity and inner hydrophobicity of the core structure of ubiquitin and SUMO, exerting a detergent-like effect on otherwise insoluble proteins.

One or more ligands can be bound to a construct partner such as a polymer that provides desired pharmacokinetic properties. For example, one or more ligands can be bound to a synthetic polymer or to a protein, such as a naturally occurring protein, that exhibits an extended half-life in the systemic circulation.

A ligand provided by the present disclosure can be conjugated to or fused to molecules that extend the serum half-life of the ligand without increasing the risk that such half-life extension would increase the likelihood or the intensity of a side-effect or adverse event in a patient. Dosing of extended serum half-life ligands can allow for prolonged target coverage with lower systemic maximal exposure ($C_{max}$). Extended serum half-life can allow for use of lower administered doses and/or a less frequent dosing regimen of s dual receptor binding construct.

The serum half-life of a ligand can be extended by any suitable method. Such methods include linking a ligand to a peptide that binds to the neonatal Fc receptor or linking a ligand to a protein having extended serum half-life such as IgG, an IgG Fc fragment or to human serum albumin (HSA).

Examples of dual receptor binding pharmacokinetic constructs include, (a) recombinantly fusing one or more ligands to a naturally long-half-life protein or protein domain such as Fc fusion, transferrin fusion or albumin fusion; (b) recombinantly fusing one or more ligands to an inert polypeptide such as XTEN®, a homoamino acid polymer (HAP, HAPylation), a proline-alanine-serine polymer (PAS, PASylation), an elastin-like peptide (ELP, ELPylation), or a gelatin-like protein GLK polymer; (c) increasing the hydrodynamic radius by chemical conjugation of one or more ligands to a repeat chemical moiety such as PEGylation or hyaluronic acid; (d) increasing the negative charge of the one or more ligands by polysialylation or by fusing to a negatively charged highly sialylated peptide such as carboxy-terminal peptide (CTP of chorionic gonadotropin (CG) β-chain); or (e) conjugating of one or more ligands to a peptide or protein-binding domain of a normally long half-life protein such as human serum albumin (HSA), transferrin, fusion to the constant fragment Fc chain of a human immunoglobulin IgG, or fusion to non-natural polypeptides such as XTEN®.

One or more ligands can be bound to a synthetic polymer. For example, a ligand can be conjugated to polyethylene glycol (PEG) chains (to extend the half-life of the ligand in the systemic circulation. A PEG can have a molecular weight, for example, from 5 kDa to 100 kDa, from 10 kDa to 80 kDa, or from 20 kDa to 60 kDa.

PEGylation can be achieved chemically or enzymatically and the biophysical and biochemical properties of the conjugate can depend, for example, on structure, size, number and location of PEG chains. PEGylation can prolong the circulation half-life of an IL-2Rβγc ligand, and IL-7Rαγc ligand and a dual receptor ligand by masking proteolytic cleavage sites and/or by increasing the effective hydrodynamic radii of the ligands, thereby reducing renal clearance.

A ligand can be conjugated to either linear or branched chain monomethoxy polyethylene glycol (mPEG), resulting in increases in the molecular mass and hydrodynamic radius and decrease the rate of glomerular filtration by the kidney. PEG is a highly flexible uncharged, mostly non-immunogenic, hydrophilic, and non-biodegradable molecule, which generates a larger hydrodynamic radius than an equivalently sized protein. PEGylation can be to lengthen the half-life of pharmacologically active compounds.

Similar to IgG, serum albumin displays an unusually long circulation half-life. Half-life prolongation of these functionally and structurally unrelated proteins is derived primarily from interaction with FcRn. Although HSA binds FcRn at a different site than IgG, both interactions are pH-dependent and result in FcRn-mediated rescue from cellular catabolism. Dual receptor binding constructs capable of extending the circulation half-life include, for example, genetic fusion to HSA, conjugation to HSA-binding moieties, and fusion to HSA-binding antibodies or antibody fragments.

One or more ligands can be bound to an XTEN® polypeptide (Amunix Pharmaceuticals Inc.). XTEN® polypeptides are generally 200 amino acids or more in length, are designed to mask antigen binding regions of scFvs, to be unstructured and to have a low immunogenicity. XTEN® polypeptides can increase the circulating half-life of therapeutic agents. One or more ligands can be bound to an XPAT® polypeptide (Amunix Pharmaceuticals, Inc.). XPAT® polypeptides include substrates for proteases and can be designed to be active with one or more proteases, to select the cleavage rate, and to impart specificity.

Genetic fusing of one or more ligands to serum transferrin (Tf) can result in enhanced pharmacokinetics. Serum transferrin is an 80 kDa glycoprotein that mediates iron transport from the systemic circulation into cells and tissues. When bound to ferric ions, transferrin displays high affinity for the transferrin receptors (TfRs) displayed on the surface of most cell types. Upon interaction, the Tf/TfR complex is internalized via receptor-mediated endocytosis into endosomes, where iron is released and Tf/TfR is then recycled to the cell surface. Fusion of protein therapeutics to Tf or TfR-binding antibodies can be used for half-life extension, targeting of malignant cells overexpressing TfRs and targeting of the rai capillary endothelium for transport of therapeutics across the blood brain barrier.

Fusion of a ligand to IgG or Fc can result in increased avidity of the ligand and provides for purification via protein G./A affinity chromatography and can prolong the circulation half-life of the ligand.

Half-life extension of dual receptor ligand/IgG fusion proteins can result from a combination of reduced renal clearance due to increased molecular size and FcRn-mediated recycling.

One or more ligands can be bound to any suitable IgG including, for example, IgG1, IgG2, or IgG4. The one or more ligands can be bound to any suitable portion of IgG such as the light chain VL or to the heavy chain VH and including the N-terminus, the C-terminus, an amino acid side chain, or can be incorporated into the amino acid sequence of the light or heavy chain of IgG.

One or more ligands can be non-covalently bound to albumin. Non-covalent binding of ligands to albumin can shield the ligands for proteolytic degradation and protect the ligands from rapid renal clearance. The nature of the non-covalent binding allows for the detachment of a ligand thereby facilitating the ability of the ligands to interact with IL-2R and IL-7R. Ligands can be modified to facilitate non-covalent binding to one or more different albumin binding protein domains that can impart a desired pharmacokinetic property to the ligand. Alternatively, albumin can be engineered to provide a desired pharmacokinetic profile for a ligand. These albumin binding domains can be used to improve the pharmacokinetics of larger compounds such as dual receptor binding constructs. A ligand can be bound to albumin through an albumin binding molecule having, for example, a high affinity to albumin. An albumin binding molecule can be fused to a ligand either recombinantly or chemically during solid-phase synthesis. Such albumin binding molecules can be either small peptides having less than 20 amino acids or non-peptidyl small molecules.

Dual receptor binding constructs provided by the present disclosure can comprise dual ligand/IgG constructs.

An IgG construct comprises at least one heavy chain and at least one light chain. A ligand can be bound to the N-terminus of the heavy chain, to the N-terminus of the light chain, to the C-terminus of the heavy chain, and/or to the C-terminus of the light chain.

A ligand can be bound to the C-terminus of the heavy chain, for example, to the CH3 domain, to the N-terminus of the heavy chain and/or to the N-terminus of the light chain.

In an IgG construct, a ligand can be bound to the N-terminus of one or both heavy chains, to the N-terminus of one or both light chains, and/or to one or both C-termini of the heavy chains.

In an IgG construct, a ligand can be bound to an amino acid side chain of IgG.

In an IgG construct, an IgG heavy chain and/or an IgG light chain can comprise one or more ligands incorporated into the amino acid sequence forming the IgG heavy chain and/or the IgG light chain.

Figure 40A:
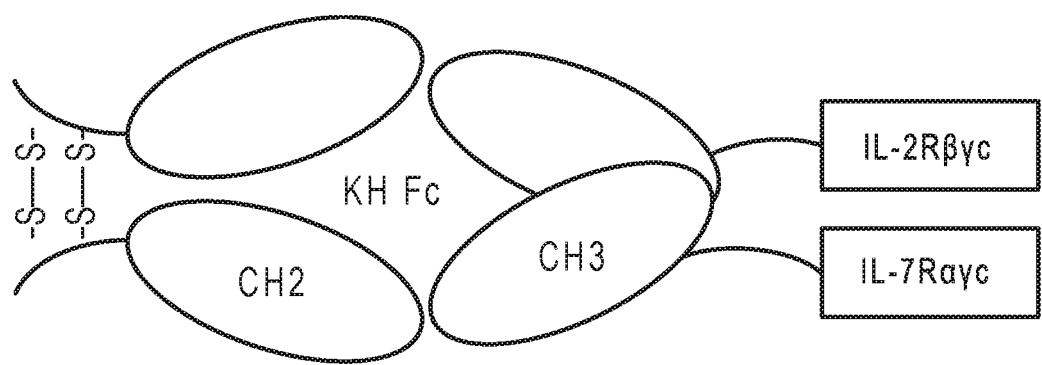
FIG. 40A shows a diagram of a dual IL-2Rβγc/IL-7Rαγc agonist provided by the present disclosure in which an IL-2Rβγc ligand and an IL-7Rαγc ligand are bound to separate CH3 domains of an hIgG1-Fc fragment.
Figure 41A:
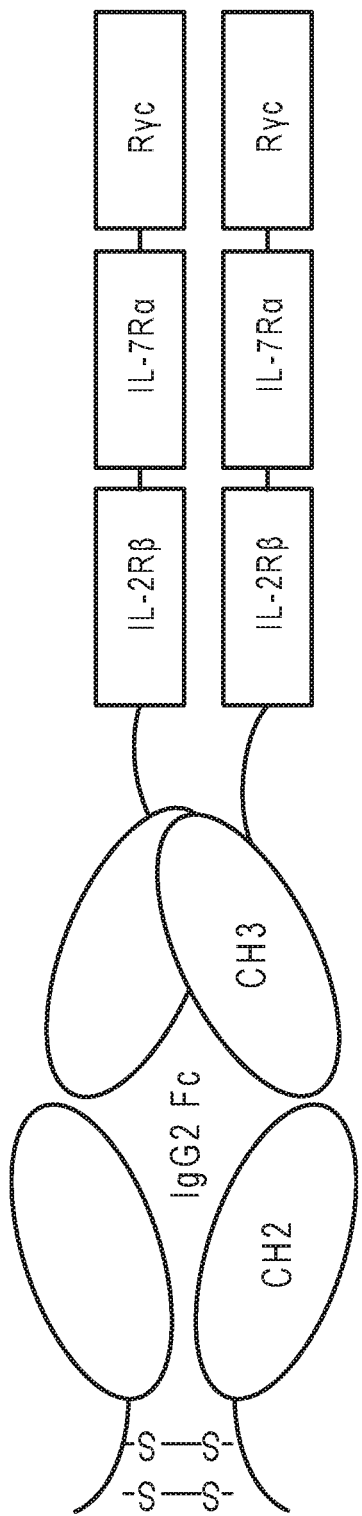
FIG. 41A shows a diagram of a linear IL-2Rβ/IL-7Rα/Rγc dual receptor ligand provided by the present disclosure in which a dual receptor binding ligand is bound to both of the CH3 domains of an hIgG1-Fc fragment.

Examples of dual receptor binding/IgG constructs are shown in FIGS. 40A and 41A.

In a dual receptor binding/igG construct each linker binding a ligand to the IgG can independently be the same or can be different.

For example, a ligand can be bound to the C-terminus of one or both IgG heavy chains, to the C-terminus of one or both IgG light chains, to the N-terminus of one or both IgG heavy chains, and/or to the N-terminus of one or both IgG light chains. Examples of dual receptor binding constructs in which a ligand is bound to the IgG heavy and/or light chains are shown in FIGS. 23A-23F. Each of the ligands can be bound to the IgG through a suitable construct linker. Referring to FIGS. 23A-23F, the ligands 233 can be bound to the heavy chains 231 and/or to the light chains 232.

One or more ligands can be bound to an IgG fragment such as a single light chain VL domain, a single heavy chain VH domain or to the Fc region. The fragments can be derived from any suitable immunoglobulin such as IgA, IgD, IgE, IgG, or IgM. The fragments can be derived from any suitable IgG such as, for example, IgG1, IgG2, or IgG4.

One or more ligands can be bound to an Fc-fragment. The Fc-fragment can be monomeric, can be dimeric, or can be a modified Fc-fragment. A dimeric Fc-fragment can comprise one or more disulfide bonds on the N-terminus. An example of a modification is a knob-into-hole modification comprising a knob modification in the CH3 domain of one of the immunoglobulin heavy chain and a hole modification in the other immunoglobulin heavy chain.

Constructs provided by the present disclosure include dual ligand-Fc fusion proteins. An Fc chain can include two different polypeptides that self-assemble into either homodimeric Fc chains or heterodimeric Fc chains. The fusion proteins can include an Fc chain, one or more Fc chain linkers, and one or more ligands. An Fc chain linker binds a ligand provided by the present disclosure to an Fc chain.

The Fc chain can comprise the Fc chain of any suitable immunoglobulin isotype including IgA, IgD, IgE, IgG, and IgM immunoglobulin isotypes. The Fc-fragment can be derived from any suitable IgG immunoglobulin including, for example, an IgG1, IgG2, or IgG4.

A dual ligand Fc-fusion protein can comprise one or more ligands. Each of the one or more ligands can be the same or can be different than other dual ligands bound to a Fc chain.

A dual ligand Fc-fragment construct, i.e., a dual ligand Fc fusion, can comprise a ligand bound to the C-terminus of one Fc-chain or to the C-terminus of both Fc-chains of the Fc-fragment.

A dual ligand Fc fusion construct can comprise one ligand bound to the N-terminus of the Fc-fragment or two ligands bound to the N-terminus of the Fc-fragment.

A dual ligand Fc fusion construct can comprise one or two ligands bound to the C-terminus of the Fc-fragment and one or two ligands can be bound to the N-terminus of the Fc-fragment.

Each ligand can be covalently bound to an Fc-fragment through an Fc linker. Each Fc linker binding an IL-7Rαγc ligand to an Fc-fragment can be the same or different.

Each ligand can independently be bound to an Fc linker through the N-terminus or through the C-terminus of the dual ligand.

Examples of ligand Fc-fragment constructs are shown in FIGS. 22A-22F. Referring to FIGS. 22A-22F, a ligand can be binding to the CH2 domain 221 and/or to the CH3 domain 222 of the light chain or heavy chain fragment.

An Fc fusion protein can comprise two Fc chains with at least one of the Fc chains comprising a fused ligand and optionally an Fc-linker. The dual receptor binding Fc-fusion proteins can be configured to have two ligands, where a ligand is covalently bound to each of the Fc chains. In a dual receptor binding Fc-fusion a ligand can be fused to each Fc chain.

In addition to homodimeric bivalent ligand Fc fusion proteins, in a monovalent ligand Fc-fusion protein, one Fc chain can be empty and heterodimerization variants can be used to bring the two Fc chains together. These embodiments rely on the use of two different variant Fc sequences, that can self-assemble to form heterodimeric Fc chains and heterodimeric Fc fusion proteins. There are a number of mechanisms that can be used to generate the heterodimers. In addition, these mechanisms can be combined to ensure high efficiency of heterodimerization. Heterodimerization variants can include steric variants such as knobs and holes or skew variants, charge pairs variants, and pH variants. Thus, a dual receptor binding construct can comprise a dual receptor binding heterodimeric Fc fragment.

Dual receptor binding constructs provided by the present disclosure include constructs in which one or more ligands are bound to a construct partner and independently one or more IL-2Rβ, IL-7Rα, and/or Rγc ligands can be bound to the construct partner. For example, a dual receptor ligand can be bound to the C-terminus of an Fc fragment or immunoglobulin and an IL-2Rβ, IL-7Rα, and/or Rγc ligand can be bound to the N-terminus of an Fc fragment or an immunoglobulin. As another example, a ligand can be bound to the C-terminus of one heavy chain of an Fc fragment or immunoglobulin and an IL-2Rβ, IL-7Rα, and/or Rγc ligand can be bound to the other heavy chain of the Fc fragment or immunoglobulin.

A construct comprising one or more IL-2Rβ ligands, one or more IL-7Rα ligands and/or one or more Rγc ligands can comprise one or more ligands bound to the construct partner. FIGS. 22A-22F and FIGS. 23A-23F show examples of Fc fragments and immunoglobulins, respectively, in which ligands are bound to the C-terminus and/or to the N-terminus of the construct partner. Each of the ligands can independently be selected from a ligand, an IL-2Rβ ligand, an IL-7Rα ligand, or an Rγc ligand.

In constructs comprising a protein or synthetic polymer, one or more IL-2Rβ ligands, one or more IL-7Rα ligands, one or more Rγc ligands, and/or one or more ligands can be bound to the construct partner. For example, the ligands can be bound to the C-terminus and N-terminus of the protein or to the terminal groups of the polymer, and/or to functionalized side chains.

Each of the one or more IL-2Rβ ligands, one or more IL-7Rα ligands, and one or more Rγc ligands can independently be bound to a construct partner through a construct linker. The construct linker can be, for example, any of the rigid or flexible linkers disclosed herein, and can be selected to facilitate a desired interaction with IL-2R and IL-7R.

A dual receptor binding construct provided by the present disclosure can comprise a construct linker covalently binding a ligand to a construct partner including, for example, any of the peptides, polymers, Fc-fragments, immunoglobulin fragments, and antibodies disclosed herein.

A construct linker can be configured to facilitate binding of a ligand to a binding site on IL-2R and IL-7R. A construct linker can be configured to facilitate activation of IL-2R and IL-7R by a ligand.

A construct linker can be a peptidyl construct linker. A peptidyl construct linker can comprise, for example, from 2 to 30 amino acids, from 2 to 25 amino acids, from 2 to 20 amino acids, from 2 to 15 amino acids or from 2 to 10 amino acids. A peptidyl construct linker can comprise, for example, less than 30 amino acids, less than 25 amino acids, less than 20 amino acids, less than 15 amino acids, less than 10 amino acids, or less than 5 amino acids. A peptidyl construct linker can comprise, for example, more than 2 amino acids, more than 4 amino acids, more than 8 amino acids, more than 12 amino acids, or more than 16 amino acids.

A peptidyl construct linker can have a length, for example, from 5 Å to 500 Å, such as from 10 Å to 400 Å, from 50 Å to 300 Å, or from 100 Å to 200 Å. A peptidyl construct linker can have a length, for example, greater than 5 Å, greater than 10 Å, greater than 50 Å, greater than 100 Å, greater than 200 Å, greater than 300 Å, or greater than 400 Å.

A construct linker can be a chemical construct linker. A chemical construct linker can have a length, for example, from 5 Å to 500 Å, such as from 10 Å to 400 Å, from 5 Å to 300 Å, or from 100 Å to 200 Å. A chemical linker can have a length, for example, greater than 5 Å, greater than 10 Å, greater than 50 Å, greater than 100 Å, greater than 200 Å, greater than 300 Å, or greater than 400 Å.

A chemical construct linker can comprise a backbone comprising, for example, from 3 to 100 bonds, from 5 to 90 bonds, from 10 to 80 bonds, or from 20 to 60 bonds. A chemical construct linker can comprise a backbone comprising, for example, greater than 3 bonds, greater than 5 bonds, greater than 10 bonds greater than 20 bonds greater than 50 bonds, or greater than 100 bonds.

Examples of suitable peptidyl construct linkers include linkers having an amino acid sequence of any one of SEQ ID NOS: 9380-9407 and 9420-9428.

A ligand can be bound to a construct linker through the N-terminus or through the C-terminus of the ligand.

In dual receptor binding constructs having more than one ligand, each of the ligands can be bound to the construct partner through an independent construct. Each of the construct linkers can be the same or at least one of the construct linkers can be different. Each of the more than one ligand can be bound to a respective construct partner through the N-terminus or through the C-terminus of the ligand.

A construct linker can comprise a cleavable construct linker. A cleavable construct linker can be cleaved in vivo, for example, in the presence of a certain pH, enzymatically, or by application of energy such as by application of electromagnetic radiation including ultraviolet light or infrared radiation.

A dual receptor binding construct can comprise one or more ligands bound to a checkpoint inhibitor, such as a PD-1 checkpoint inhibitor including, for example, an antibody checkpoint inhibitor such as pembrolizumab and cemiplimab.

Ina dual receptor binding checkpoint inhibitor construct, the one or more ligands can have the amino acid sequence, for example, of any one of SEQ ID NOS: 4001-4007, 4021-4028, and 4041-4058, or an amino acid sequence having greater than 60%, greater than 70%, greater than 80%, greater than 85%, greater than 90%, or greater than 95% amino acid sequence similarity to any one of SEQ ID NOS: 4001-4007, 4021-4028, and 4041-4058.

In dual receptor binding checkpoint inhibitor antibody constructs the one or more ligands can have an amino acid sequence of any one of SEQ ID NOS: 4001-4007, 4021-4028, and 4041-4058 or one or more ligands having an amino acid sequence similarity to any one of SEQ ID NOS: 4001-4007, 4021-4028, and 4041-4058 bound to the C-terminus of one heavy chain, the C-terminus of both heavy chains, the N-terminus of one heavy chain, the N-terminus of both heavy chains, the N-terminus of one light chain, the N-terminus of both light chains, or a combination of any of the foregoing. Each of the one or more ligands can independently be bound to the checkpoint inhibitor antibody through a construct linker, which can comprise, for example, from 1 to 50 amino acids.

The N-terminus of the ligand can be bound to the checkpoint inhibitor antibody through the construct linker.

A construct linker can be a peptidyl linker such as a flexible linker or a rigid linker. A peptidyl linker can have, for example, an amino acid sequence selected from any one of SEQ ID NOS: 9380-9407. A peptidyl linker can have, for example, an amino acid sequence selected from any one of SEQ ID NOS: 9420-9428, A construct linker can be selected such that a ligand to which the construct linker is bound acts as an or IL-2R agonist and/or IL-7R agonist.

A dual receptor binding construct can be a pembrolizumab/ligand fusion protein where the light chain has the amino acid sequence of SEQ ID NO: 8118 (FIG. 39B), or an amino acid sequence having greater than 60%, greater than 70%, greater than 80%, greater than 85%, greater than 90%, or greater than 95% amino acid sequence similarity to SEQ ID NO: 8118 (FIG. 39B; FP7); and the heavy chain has the amino acid sequence of SEQ ID NO: 8119 (FIG. 39B; FP8)), or an amino acid sequence having greater than 60%, greater than 70%, greater than 80%, greater than 85%, greater than 90%, or greater than 95% amino acid sequence similarity to SEQ ID NO: 8119 (FIG. 39B; FP8).

A pembrolizumab/ligand fusion protein can comprise two pembrolizumab heavy chains and two pembrolizumab light chains, wherein a ligand having an amino acid sequence of any one of SEQ ID NO: 4001-4007, 4021-4028, and 4041-4058 or an amino acid sequence having greater than 60%, greater than 70%, greater than 80%, greater than 85%, greater than 90%, or greater than 95% amino acid sequence similarity to SEQ ID NOS: 4001-4007, 4021-4028, and 4041-4058 is bound to the C-terminus of one heavy chain, the C-terminus of both heavy chains, the N-terminus of one heavy chain, the N-terminus of both heavy chains, the N-terminus of one light chain, the N-terminus of both light chains, or a combination of any of the foregoing. Each of the one or more ligands can independently be bound to the pembrolizumab antibody through a construct linker, which can comprise, for example, from 1 to 50 amino acids.

The N-terminus of the ligand can be bound to pembrolizumab through the construct linker.

A dual receptor binding construct can be a hIgG2/dual ligand fusion protein and one or more ligands having an amino acid sequence of any one of SEQ ID NOS: 4001-4007, 4021-4028, and 4041-4058 or an amino acid sequence greater than 60%, greater than 70%, greater than 80%, greater than 85%, greater than 90%, or greater than 95% amino acid sequence similarity to any one of SEQ ID NOS: 4001-4007, 4021-4028, and 4041-4058 is bound to one C-terminus of hIgG2, both C-termini of hIgG2, one N-terminus of hIgG2, both N-termini of hIgG2, or a combination of any of the foregoing. Each of the one or more ligands can independently be bound to IgG2 through a construct linker, which can comprise, for example, from 1 to 50 amino acids. The IgG fusion partner can be hIgG1 or hIgG4 and the one or more ligands can be bound to the hIgG1 or hIgG4 fusion partner as described for hIgG2.

The N-terminus of the ligand can be bound to hIgG2 through the construct linker.

A dual ligand/immunoglobulin fusion protein can comprise one or more ligands bound to an immunoglobulin such as hIgG1, hIgG2, hIgG3, or hIgG4. Examples dual ligand/immunoglobulin constructs are shown in FIGS. 40A-40F and 41A-41F, where the immunoglobulin comprises heavy chains 231 and light chains 232, and ligands 233 bound to either the C-terminus and/or the N-terminus of the heavy chains 231 and/or of the light chains 232.

A dual receptor binding construct can comprise an IL-2Rβγc ligand and an IL-7Rαγc ligand provided by the present disclosure bound to each of the CH3 domains of an immunoglobulin Fc-fragment. The IL-2Rβγc ligand can have, for example, the amino acid sequence of SEQ ID NOS: 4001-4007 such as SEQ ID NO: 4001, or an amino acid sequence having greater than 60%, greater than 70%, greater than 80%, greater than 85%, greater than 90%, or greater than 95% amino acid sequence similarity to SEQ ID NOS: 4001-4007. The IL-7Rαγc ligand can have, for example, the amino acid sequence of SEQ ID NOS: 4021-4028 such as SEQ ID NO: 4021, or an amino acid sequence having greater than 60%, greater than 70%, greater than 80%, greater than 85%, greater than 90%, or greater than 95% amino acid sequence similarity to SEQ ID NOS: 4021-4028.

A dual receptor binding construct can comprise a dual receptor binding ligand bound to an immunoglobulin Fc-fragment. For example, a linear dual receptor binding ligand of any one of SEQ ID NOS: 4041-4058 or an amino acid sequence having greater than 60%, greater than 70%, greater than 80%, greater than 85%, greater than 90%, or greater than 95% amino acid sequence similarity to SEQ ID NOS: 4041-4058 can be bound to one or both of the CH3 domains.

The ligands can be bound to the C-terminus and/or to the N-terminus and to one or both of the Fc-chains of the Fc fragment. As shown in FIGS. 40A-40F and 41A-41F, a ligand 223 can be bound to one or both Fc-chains 221 and 222.

Examples of amino acid sequences of dual receptor binding constructs comprising hIgG1 or hIgG2 immunoglobulin Fc-fragments are provided in Table 4.

TABLE 4

| Ligand immunoglobulin constructs. |
|---|
| IL-2Rβγc and IL-7Rαγc Ligand Constructs<br>hIgG1-Fc-Knob IL-2Rβγc Ligand $(GS)_{10}$<br>SEQ ID NO: 8001<br>DKTHTCPPCPAPEAAGGPSVFLFPPKPKDTLMISRTPEVTCVVVDVSHE<br>DPEVKFNWYVDGVEVHNAKTKPREEQYNSTYRVVSVLTVLHQDWLNGKE<br>YKCKVSNKALPAPIEKTISKAKGQPREPQVYTLPPSREEMTKNQVSLWC<br>LVKGFYPSDIAVEWESNGQPENNYKTTPPVLDSDGSFFLYSKLTVDKSR<br>WQQGNVFSCSVMHEALHNHYTQKSLSLSPGGSGSGSGSGSGSGSGSGSG<br>SGGWYPCWMAQLGELCDLDGGGGSGGVVCQDWEGVELCWQGG |
| hIgG1-Fc-Hole IL-7Rαγc Ligand $(GS)_{10}$<br>SEQ ID NO: 8002<br>DKTHTCPPCPAPEAAGGPSVFLFPPKPKDTLMISRTPEVTCVVVDVSHE<br>DPEVKFNWYVDGVEVHNAKTKPREEQYNSTYRVVSVLTVLHQDWLNGKE |

TABLE 4-continued

Ligand immunoglobulin constructs.

YKCKVSNKALPAPIEKTISKAKGQPREPQVYTLPPSREEMTKNQVSLSC
AVKGFYPSDIAVEWESNGQPENNYKTTPPVLDSDGSFFLVSKLTVDKSR
WQQGNVFSCSVMHEALHNHYTQKSLSLSPGGSGSGSGSGSGSGSGSGSG
SGGVHRIPWCTLDPGGLQCAWLRQMGGGGSGGVVCQDWEGVELCWQGG hIgG1-Fc-Knob IL-2Rβγc Ligand (GS)10 hinge extension
SEQ ID NO: 8003
AKTEPKSSDKTHTCPPCPAPEAAGGPSVFLFPPKPKDTLMISRTPEVTC
VVVDVSHEDPEVKFNWYVDGVEVHNAKTKPREEQYNSTYRVVSVLTVLH
QDWLNGKEYKCKVSNKALPAPIEKTISKAKGQPREPQVYTLPPSREEMT
KNQVSLWCLVKGFYPSDIAVEWESNGQPENNYKTTPPVLDSDGSFFLYS
KLTVDKSRWQQGNVFSCSVMHEALHNHYTQKSLSLSPGGSGSGSGSGSG
SGSGSGSGSGGWYPCWMAQLGELCDLDGGGGSGGVVCQDWEGVELCWQGG hIgG1-Fc-Hole IL-7Rαγc Ligand (GS)10 hinge extension
SEQ ID NO: 8004
AKTEPKSSDKTHTCPPCPAPEAAGGPSVFLFPPKPKDTLMISRTPEVTC
VVVDVSHEDPEVKFNWYVDGVEVHNAKTKPREEQYNSTYRVVSVLTVLH
QDWLNGKEYKCKVSNKALPAPIEKTISKAKGQPREPQVYTLPPSREEMT
KNQVSLSCAVKGFYPSDIAVEWESNGQPENNYKTTPPVLDSDGSFFLVS
KLTVDKSRWQQGNVFSCSVMHEALHNHYTQKSLSLSPGGSGSGSGSGSG
SGSGSGSGSGGVHRIPWCTLDPGGLQCAWLRQMGGGGSGGVVCQDWEGV
ELCWQGG hIgG1-Fc-Knob IL-2Rβγc Ligand (PA)10 hinge extension
SEQ ID NO: 8008
ERKSSVECPPCPAPPVAGPSVFLFPPKPKDTLMISRTPEVTCVVVDVSH
EDPEVQFNWYVDGVEVHNAKTKPREEQFNSTFRVVSVLTVVHQDWLNGK
EYKCKVSNKGLPAPIEKTISKTKGQPREPQVYTLPPSREEMTKNQVSLT
CLVKGFYPSDIAVEWESNGQPENNYKTTPPMLDSDGSFFLYSKLTVDKS
RWQQGNVFSCSVMHEALHNHYTQKSLSLSPGAPAPAPAPAPAPAPAP
APAGGWYPCWMAQLGELCDLDGGGGSGGVVCQDWEGVELCWQGG hIgG1-Fc-Hole IL-7Rαγc Ligand (GS)10 hinge extension
SEQ ID NO: 8009
ERKSSVECPPCPAPPVAGPSVFLFPPKPKDTLMISRTPEVTCVVVDVSH
EDPEVQFNWYVDGVEVHNAKTKPREEQFNSTFRVVSVLTVVHQDWLNGK
EYKCKVSNKGLPAPIEKTISKTKGQPREPQVYTLPPSREEMTKNQVSLT
CLVKGFYPSDIAVEWESNGQPENNYKTTPPMLDSDGSFFLYSKLTVDKS
RWQQGNVFSCSVMHEALHNHYTQKSLSLSPGAGSGSGSGSGSGSGSGSG
SGSGGVHRIPWCTLDPGGLQCAWLRQMGGGGSGGVVCQDWEGVELCWQGG Linear Dual Receptor Ligand Constructs
hIgG2-Fc IL-2Rβ/Rγc/IL-7Rα Ligand (GS)10
SEQ ID NO: 8005
APLERKSSVECPPCPAPPVAGPSVFLFPPKPKDTLMISRTPEVTCVVVD
VSHEDPEVQFNWYVDGVEVHNAKTKPREEQFNSTFRVVSVLTVVHQDWL
NGKEYKCKVSNKGLPAPIEKTISKTKGQPREPQVYTLPPSREEMTKNQV
SLTCLVKGFYPSDIAVEWESNGQPENNYKTTPPMLDSDGSFFLYSKLTV
DKSRWQQGNVFSCSVMHEALHNHYTQKSLSLSPGARTGSGSGSGSGSGS
GSGSGSGSGGWYPCWMAQLGELCDLDGGGGSGGVVCQDWEGVELCWQGG
GGSGGVHRIPWCTLDPGGLQCAWLRQMGG hIgG2-Fc IL-7Rα/IL-2Rβ/Rγc Ligand (GS)10
SEQ ID NO: 8006
APLERKSSVECPPCPAPPVAGPSVFLFPPKPKDTLMISRTPEVTCVVVD
VSHEDPEVQFNWYVDGVEVHNAKTKPREEQFNSTFRVVSVLTVVHQDWL
NGKEYKCKVSNKGLPAPIEKTISKTKGQPREPQVYTLPPSREEMTKNQV
SLTCLVKGFYPSDIAVEWESNGQPENNYKTTPPMLDSDGSFFLYSKLTV
DKSRWQQGNVFSCSVMHEALHNHYTQKSLSLSPGARTGSGSGSGSGSGS
GSGSGSGSGGVHRIPWCTLDPGGLQCAWLRQMGGGGSGGWYPCWMAQLG
ELCDLDGGGGSGGVVCQDWEGVELCWQGG hIgG2-Fc IL-2Rβ/IL-7Rα/Rγc Ligand (GS)10
SEQ ID NO: 8007
APLERKSSVECPPCPAPPVAGPSVFLFPPKPKDTLMISRTPEVTCVVVD
VSHEDPEVQFNWYVDGVEVHNAKTKPREEQFNSTFRVVSVLTVVHQDWL
NGKEYKCKVSNKGLPAPIEKTISKTKGQPREPQVYTLPPSREEMTKNQV
SLTCLVKGFYPSDIAVEWESNGQPENNYKTTPPMLDSDGSFFLYSKLTV
DKSRWQQGNVFSCSVMHEALHNHYTQKSLSLSPGARTGSGSGSGSGSGS
GSGSGSGSGGWYPCWMAQLGELCDLDGGGGSGGVHRIPWCTLDPGGLQC
AWLRQMGGGGSGGVVCQDWEGVELCWQGG Examples of constructs comprising an IL-2Rβγc ligand bound to an hIgG1 or hIgG2 immunoglobulin Fc-fragment are provided in Table 5.

TABLE 5

Ligand immunoglobulin constructs.

hIgG2-Fc-(PA)10 IL-2Rβγc ligand
SEQ ID NO: 8061
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAPAGG
WYPCWIARVGELCDLEEGPVNRGGGGSGGVVCQDWEGVELCWQGG hIgG2-Fc-(PA)10 IL-2Rβγc ligand
SEQ ID NO: 8062
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAPAGG
AVEFYPCWLARIGELCDLVEPGGGGSGGVVCQDWEGVELCWQGG hIgG2-Fc-(PA)10 IL-2Rβγc ligand
SEQ ID NO: 8063
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAPAGG
WYPCWIARVGELCDMEGGGGSGGVVCQDWEGVELCWQGG hIgG2-Fc-(PA)10 IL-2Rβγc ligand
SEQ ID NO: 8064
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAPAGG
EWFHDCFLAKVGDLCDLFLWGGGGSGGVVCQDWEGVELCWQGG hIgG2-Fc-(PA)10 IL-2Rβγc ligand
SEQ ID NO: 8065
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAPAGG
RYVHDCFIAQVGDLCDLFLHGGGGSGGVVCQDWEGVELCWQGG hG2-Fc-(PA)10 IL-2Rβγc ligand
SEQ ID NO: 8066
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAPAGG
RSLVDCFLVKVGDLCDFFNWGGGGSGGVVCQDWEGVELCWQGG hIgG2-Fc-(PA)10 IL-2Rβγc ligand
SEQ ID NO: 8067
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAPAGG
WYPCWIARVGELCDLEGGGGSGGVVCQDWEGVELCWQGG hIgG2-Fc-(PA)10 IL-2Rβγc ligand
SEQ ID NO: 8068
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAPAGG
WYPCWLAQVGELCDLGGGGSGGVVCQDWEGVELCWQGG hIgG2-Fc-(PA)10 IL-2Rβγc ligand
SEQ ID NO: 8069
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ TABLE 5-continued Ligand immunoglobulin constructs.

GNVFSCSVMHEALHNHYTQKSLSLSPGAPAPAPAPAPAPAPAPAPAGG
WYPCWIARVGELCDLEEGPVNRGGGGSGGGGSGGVVCQDWEGVELCWQGG hIgG2-Fc-(PA)10 IL-2Rβγc ligand
SEQ ID NO: 8070
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAGG
WYPCWIARVGELCDLEEGPVNRGGGGSGGGGSGGGGSGGVVCQDWEGVEL
CWQGG hIgG2-Fc-(PA)10 IL-2Rβγc ligand
SEQ ID NO: 8071
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAGG
WYPCWIARVGELCDLEEGPVNRGGGGSGGGGSGGGGSGGGGSGGVVCQDW
EGVELCWQGG hIgG2-Fc-(PA)10 IL-2Rβγc ligand
SEQ ID NO: 8072
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAGG
RYVHDCFIAQVGDLCDLFLHGGGGSGGGGSGGVVCQDWEGVELCWQGG hIgG2-Fc-(PA)10 IL-2Rβγc ligand
SEQ ID NO: 8073
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAGG
RYVHDCFIAQVGDLCDLFLHGGGGSGGGGSGGGGSGGVVCQDWEGVELCW
QGG hIgG2-Fc-(PA)10 IL-2Rβγc ligand
SEQ ID NO: 8074
ERKSSVECPPCPAPPVAGPSVFLFPPKPKDTLMISRTPEVTCVVVDVSHE
DPEVQFNWYVDGVEVHNAKTKPREEQFNSTFRVVSVLTVVHQDWLNGKEY
KCKVSNKGLPAPIEKTISKTKGQPREPQVYTLPPSREEMTKNQVSLTCLV
KGFYPSDIAVEWESNGQPENNYKTTPPMLDSDGSFFLYSKLTVDKSRWQQ
GNVFSCSVMHEALHNHYTQKSLSLSPGAPAPAPAPAPAPAPAPAPAGG
RYVHDCFIAQVGDLCDLFLHGGGGSGGGGSGGGGSGGGGSGGVVCQDWEG
VELCWQGG ZW1 A-(PA)10 IL-2Rβγc ligand
SEQ ID NO: 8075
DKTHTCPPCPAPEAAGGPSVFLFPPKPKDTLMISRTPEVTCVVVDVSHED
PEVKFNWYVDGVEVHNAKTKPREEQYNSTYRVVSVLTVLHQDWLNGKEYK
CKVSNKALGAPIEKTISKAKGQPREPQVYVYPPSRDELTKNQVSLTCLVK
GFYPSDIAVEWESNGQPENNYKTTPPVLDSDGSFALVSKLTVDKSRWQQG
NVFSCSVMHEALHNHYTQKSLSLSPGAPAPAPAPAPAPAPAPAPAGGL
VDCFKVKVGELCDLFGGGGSGGVVCQDWEGVELCWQGG ZW1_B
SEQ ID NO: 8076
DKTHTCPPCPAPEAAGGPSVFLFPPKPKDTLMISRTPEVTCVVVDVSHED
PEVKFNWYVDGVEVHNAKTKPREEQYNSTYRVVSVLTVLHQDWLNGKEYK
CKVSNKALGAPIEKTISKAKGQPREPQVYVLPPSRDELTKNQVSLLCLVK
GFYPSDIAVEWESNGQPENNYLTWPPVLDSDGSFFLYSKLTVDKSRWQQG
NVFSCSVMHEALHNHYTQKSLSLSPG Cys-Knob-(PA)10 IL-2Rβγc ligand
SEQ ID NO: 8077
DKTHTCPPCPAPEAAGGPSVFLFPPKPKDTLMISRTPEVTCVVVDVSHED
PEVKFNWYVDGVEVHNAKTKPREEQYNSTYRVVSVLTVLHQDWLNGKEYK
CKVSNKALGAPIEKTISKAKGQPREPQVYTLPPCRDELTKNQVSLWCLVK
GFYPSDIAVEWESNGQPENNYKTTPPVLDSDGSFFLYSKLTVDKSRWQQG
NVFSCSVMHEALHNHYTQKSLSLSPGAPAPAPAPAPAPAPAPAPAGGL
VDCFKVKVGELCDLFGGGGSGGVVCQDWEGVELCWQGG Cys-Hole
SEQ ID NO: 8078
DKTHTCPPCPAPEAAGGPSVFLFPPKPKDTLMISRTPEVTCVVVDVSHED
PEVKFNWYVDGVEVHNAKTKPREEQYNSTYRVVSVLTVLHQDWLNGKEYK
CKVSNKALGAPIEKTISKAKGQPREPQVCTLPPSRDELTKNQVSLSCAVK
GFYPSDIAVEWESNGQPENNYKTTPPVLDSDGSFFLYSKLTVDKSRWQQG
NVFSCSVMHEALHNHYTQKSLSLSPG ZW1_A-(PA)10 IL-2Rβγc ligand
SEQ ID NO: 8079
DKTHTCPPCPAPEAAGGPSVFLFPPKPKDTLMISRTPEVTCVVVDVSHED
PEVKFNWYVDGVEVHNAKTKPREEQYNSTYRVVSVLTVLHQDWLNGKEYK
CKVSNKALGAPIEKTISKAKGQPREPQVYVYPPSRDELTKNQVSLTCLVK
GFYPSDIAVEWESNGQPENNYKTTPPVLDSDGSFALVSKLTVDKSRWQQG
NVFSCSVMHEALHNHYTQKSLSLSPGAPAPAPAPAPAPAPAPAPAGGR
YVHDCFIAQVGDLCDLFLHGGGGSGGVVCQDWEGVELCWQGG Cys-Knob-(PA)10 IL-2Rβγc ligand
SEQ ID NO: 8080
DKTHTCPPCPAPEAAGGPSVFLFPPKPKDTLMIS RTPEVTCVVVDVSHE
DPEVKFNWYVDGVEVHNAKTKPREEQYNSTYRVVSVLTVLHQDWLNGKEY
KCKVSNKALGAPIEKTISKAKGQPREPQVYTLPPCRDELTKNQVSLTCLV
KGFYPSDIAVEWESNGQPENNYKTTPPVLDSDGSFFLYSKLTVDKSRWQQ
GNVFSCSVMHEALHNHYTQKSLSLSPGAPAPAPAPAPAPAPAPAPAGG
RYVHDCFIAQVGDLCDLFLHGGGGSGGGGSGGVVCQDWEGVELCWQGG ZW1_A- (GS)10 IL-2Rβγc ligand
SEQ ID NO: 8081
DKTHTCPPCPAPEAAGGPSVFLFPPKPKDTLMISRTPEVTCVVVDVSHED
PEVKFNWYVDGVEVHNAKTKPREEQYNSTYRVVSVLTVLHQDWLNGKEYK
CKVSNKALGAPIEKTISKAKGQPREPQVYVYPPSRDELTKNQVSLTCLVK
GFYPSDIAVEWESNGQPENNYKTTPPVLDSDGSFALVSKLTVDKSRWQQG
NVFSCSVMHEALHNHYTQKSLSLSPGGSGSGSGSGSGSGSGSGGWY
SCWMAQLGELCDLDGGGGSGGVVCQDWEGVELCWQGG Cys-Knob-(GS)10 IL-2Rβγc ligand
SEQ ID NO: 8082
DKTHTCPPCPAPEAAGGPSVFLFPPKPKDTLMISRTPEVTCVVVDVSHED
PEVKFNWYVDGVEVHNAKTKPREEQYNSTYRVVSVLTVLHQDWLNGKEYK
CKVSNKALGAPIEKTISKAKGQPREPQVYTLPPCRDELTKNQVSLWCLVK
GFYPSDIAVEWESNGQPENNYKTTPPVLDSDGSFFLYSKLTVDKSRWQQG
NVFSCSVMHEALHNHYTQKSLSLSPGGSGSGSGSGSGSGSGSGGWY
SCWMAQLGELCDLDGGGGSGGVVCQDWEGVELCWQGG The components of the IL-2Rβγc ligand constructs having SEQ ID NOS: 8061-8082 is summarized in Table 6.

TABLE 6

Components of IL-2Rβγc ligand constructs.

| IL-2Rβγc Ligand Construct | Construct | Linker | IL-2Rβ Ligand | IL-2Rβγc Ligand Linker | IL-2Rγc Ligand |
|---|---|---|---|---|---|
| SEQ ID NO: 8061 | hIgG2-Fc | (PA)10 (SEQ ID NO: 9423) | SEQ ID NO: 930 | GGGGS (SEQ ID NO: 9395) | SEQ ID NO: 9340 |

TABLE 6-continued

Components of IL-2Rβγc ligand constructs.

| IL-2Rβγc Ligand Construct | Construct | Linker | IL-2Rβ Ligand | IL-2Rβγc Ligand Linker | IL-2Rγc Ligand |
|---|---|---|---|---|---|
| SEQ ID NO: 8062 | hIgG2-Fc | (PA)10 (SEQ ID NO: 9423) | SEQ ID NO: 931 | GGGGS (SEQ ID NO: 9395) | SEQ ID NO: 9340 |
| SEQ ID NO: 8063 | hIgG2-Fc | (PA)10 (SEQ ID NO: 9423) | SEQ ID NO: 932 | GGGGS (SEQ ID NO: 9395) | SEQ ID NO: 9340 |
| SEQ ID NO: 8064 | hIgG2-Fc | (PA)10 (SEQ ID NO: 9423) | SEQ ID NO: 933 | GGGGS (SEQ ID NO: 9395) | SEQ ID NO: 9340 |
| SEQ ID NO: 8065 | hIgG2-Fc | (PA)10 (SEQ ID NO: 9423) | SEQ ID NO: 934 | GGGGS (SEQ ID NO: 9395) | SEQ ID NO: 9340 |
| SEQ ID NO: 8066 | hIgG2-Fc | (PA)10 (SEQ ID NO: 9423) | SEQ ID NO: 935 | GGGGS (SEQ ID NO: 9395) | SEQ ID NO: 9340 |
| SEQ ID NO: 8067 | hIgG2-Fc | (PA)10 (SEQ ID NO: 9423) | SEQ ID NO: 936 | GGGGS (SEQ ID NO: 9395) | SEQ ID NO: 9340 |
| SEQ ID NO: 8068 | hIgG2-Fc | (PA)10 (SEQ ID NO: 9423) | SEQ ID NO: 937 | GGGGS (SEQ ID NO: 9395) | SEQ ID NO: 9340 |
| SEQ ID NO: 8069 | hIgG2-Fc | (PA)10 (SEQ ID NO: 9423) | SEQ ID NO: 930 | (GGGGS)2 (SEQ ID NO: 9396) | SEQ ID NO: 9340 |
| SEQ ID NO: 8070 | hIgG2-Fc | (PA)10 (SEQ ID NO: 9423) | SEQ ID NO: 930 | (GGGGS)3 (SEQ ID NO: 9397) | SEQ ID NO: 9340 |
| SEQ ID NO: 8071 | hIgG2-Fc | (PA)10 (SEQ ID NO: 9423) | SEQ ID NO: 930 | (GGGGS)4 (SEQ ID NO: 9398) | SEQ ID NO: 9340 |
| SEQ ID NO: 8072 | hIgG2-Fc | (PA)10 (SEQ ID NO: 9423) | SEQ ID NO: 934 | (GGGGS)2 (SEQ ID NO: 9396) | SEQ ID NO: 9340 |
| SEQ ID NO: 8073 | hIgG2-Fc | (PA)10 (SEQ ID NO: 9423) | SEQ ID NO: 934 | (GGGGS)3 (SEQ ID NO: 9397) | SEQ ID NO: 9340 |
| SEQ ID NO: 8074 | hIgG2-Fc | (PA)10 (SEQ ID NO: 9423) | SEQ ID NO: 934 | (GGGGS)4 (SEQ ID NO: 9398) | SEQ ID NO: 9340 |
| SEQ ID NO: 8075 | ZW1_A | (PA)10 (SEQ ID NO: 9423) | SEQ ID NO: 938 | GGGGS (SEQ ID NO: 9395) | SEQ ID NO: 9340 |
| SEQ ID NO: 8076 | ZW1_B | — | — | — | — |
| SEQ ID NO: 8077 | Cys-Knob | (PA)10 (SEQ ID NO: 9423) | SEQ ID NO: 938 | GGGGS (SEQ ID NO: 9395) | SEQ ID NO: 9340 |
| SEQ ID NO: 8078 | Cys-Hole | (PA)10 (SEQ ID NO: 9423) | — | GGGGS (SEQ ID NO: 9395) | — |
| SEQ ID NO: 8079 | ZW1-A | (PA)10 (SEQ ID NO: 9423) | SEQ ID NO: 934 | GGGGS (SEQ ID NO: 9395) | SEQ ID NO: 9340 |
| SEQ ID NO: 8080 | Cys-Knob | (PA)10 (SEQ ID NO: 9423) | SEQ ID NO: 934 | GGGGS (SEQ ID NO: 9395) | SEQ ID NO: 9340 |

TABLE 6-continued

Components of IL-2Rβγc ligand constructs.

| IL-2Rβγc Ligand Construct | Construct | Linker | IL-2Rβ Ligand | IL-2Rβγc Ligand Linker | IL-2Rγc Ligand |
|---|---|---|---|---|---|
| SEQ ID NO: 8081 | ZWLA | (PA)10 (SEQ ID NO: 9423) | SEQ ID NO: 939 | GGGGS (SEQ ID NO: 9395) | SEQ ID NO: 9340 |
| SEQ ID NO: 8082 | Cys-Knob | (PA)10 (SEQ ID NO: 9423) | SEQ ID NO: 939 | GGGGS (SEQ ID NO: 9395) | SEQ ID NO: 9340 |

The Fc-fragment can be derived, for example, from any suitable immunoglobulin such as hIgG1, hIgG2, hIgG3, or hIgG4.

The N-terminus of the ligand can be bound to an Fc-fragment through a construct linker. The construct linker can be a peptidyl linker such as a flexible linker or a rigid linker. A peptidyl linker can have, for example, an amino acid sequence selected from any one of SEQ ID NOS: 9380-9407. A peptidyl linker can have, for example, an amino acid sequence selected from any one of SEQ ID NOS: 9420-9428. A construct linker can be selected such that a ligand to which the construct linker is bound acts as an or IL-2R agonist and/or IL-7R agonist. Functionally, a dual receptor binding compound provided by the present disclosure can be, for example, a full IL-2R agonist and a full IL-7R agonist, a full IL-2R agonist and a partial IL-7R agonist, a partial IL-2R agonist and a full IL-7R agonist, an IL-2R antagonist and an IL-7R antagonist, a diagnostic reagent, an imaging reagent, a targeting compound, a cytotoxic compound, and/or a compound exhibiting dual pharmacology.

A dual receptor binding compound provided by the present disclosure can be attached to one or more moieties that impart a property to the compound that enhances therapeutic efficacy. Examples of properties include potency, aqueous solubility, polarity, lipophilicity, pharmacokinetics, targeting, bioavailability, pH-dependent binding, bioactivity, pharmacodynamics, cellular activity, metabolism, efficacy, reversible incapacitation (caging), selectivity, or a combination of any of the foregoing.

A dual receptor binding compound can comprise one or more moieties that are cleavable in vivo. The moiety can be cleavable in a target-specific environment such as, for example, by a target specific or target enriched enzyme, or by pH. The moiety can be cleavable upon exposure to electromagnetic energy such as visible light or infrared radiation and/or by exposure to thermal energy.

A dual receptor binding compound can include, for example, a tumor-targeting moiety such as, for example, a tumor-specific antibody, a tumor-specific antibody fragment, a tumor-specific protein, a tumor-specific peptide, a non-peptidyl tumor cell ligand, or a combination of any of the foregoing.

A dual receptor binding compound can include an immune cell-targeting moiety such as, for example, an immune cell-specific antibody, an immune cell-specific antibody fragment, an immune cell-specific protein, an immune cell-specific peptide, a non-peptidyl immune cell-ligand, or a combination of any of the foregoing.

A dual receptor binding compound can bind to the IL-2Rβ subunit and to the Rγc subunit of IL-2R and can activate the IL-2 receptor and can bind to the IL-7Rα subunit and to the Rγc subunit of IL-7R and can activate the IL-7 receptor. An IL-2Rβγc ligand that functions as an IL-2R agonist can independently bind to the IL-2Rβ subunit and to the Rγc subunit with an $IC_{50}$, for example, of less than 100 μM, less than 10 μM, less than 1 μM, less than 100 nM, less than 10 nM, or less than 1 nM. An IL-2R agonist can bind to the IL-2Rβ subunit and/or to the Rγc subunit either competitively or non-competitively with IL-2. An IL-7Rαγc ligand that functions as an IL-7R agonist can independently bind to the IL-7Rα subunit and to the Rγc subunit with an $IC_{50}$, for example, of less than 100 μM, less than 10 μM, less than 1 μM, less than 100 nM, less than 10 nM, or less than 1 nM. An IL-7R agonist can bind to the IL-7Rα subunit and/or to the Rγc subunit either competitively or non-competitively with IL-7.

A dual receptor binding compound can be configured to more potently activate cells expressing the IL-2Rβ subunit, the IL-7Rα subunit and the Rγc subunit, thereby facilitating the ability to differentially activate IL-2R and IL-7R expressed on the surface of different cell types by controlling dose of the agonist. For example, when incubated with a dual receptor binding compound comprising an IL-2Rβ ligand, an IL-7Rα ligand and an Rγc ligand, primary human peripheral blood mononuclear cells (PBMC) expressing the IL-2Rβ, IL-7Rα, and Rγc subunits phosphorylate signal transducer and activator of transcription 5 (STAT5).

A dual receptor binding compound provided by the present disclosure can partially activate the IL-2 receptor and/or the IL-7 receptor. Partial activation refers to a level of activation, that is, for example, less than 75% of maximum activation, less than 50%, less than 25%, less than 10%, or less than 1% of the maximum activation. Maximum activation ($E_{max}$) refers to the amplitude of cellular signal (activation) achievable at high agonist concentration such as a high concentration of IL-2 and/or IL-7. Partial IL-2R agonists can be effective in modulating the levels of response of IL-2R to activation of the IL-2Rβ and Rγc subunits among different cell types expressing IL-2R. For example, different cell types are known to vary in expression levels of each of the IL-2R subunits, i.e., the IL-2Rβ and Rγc subunits, and to exhibit different sensitivities to IL-2R agonists. Partial IL-7R agonists can be effective in modulating the levels of response of IL-7R to activation of the IL-7Rα and Rγc subunits among different cell types expressing IL-7R. For example, different cell types are known to vary in expression levels of each of the IL-7R subunits, i.e, the IL-7Rα and Rγc subunits, and to exhibit different sensitivities to IL-7R agonists.

A dual receptor binding compound can comprise an IL-2Rβ ligand, an IL-7Rα ligand and a modified Rγc ligand. Modified Rγc ligands can be selected or designed to bind and activate IL-2R and/or IL-7R, but with low or modest affinity and potency to IL-2R and/or IL-7R. Such IL-2R agonists and IL-7R agonists can have greater differential sensitivity for IL-2Rβ and IL-7R activation between cells that highly express IL-2Rβ and IL-7Rα and cells having a low level of IL-2Rβ and IL-7Rα expression.

A dual receptor binding compound can comprise one or more IL-2Rβγc ligands and one or more IL-7Rαγc ligands. The presence of multiple IL-2Rβγc ligands and/or multiple IL-7Rαγc ligands can preferentially increase the potency of an IL-2R agonist and/or IL-7R agonist on cells that highly express IL-2Rβ, IL-7Rα and/or Rγc compared to cells having low expression levels of IL-2Rβ, IL-7Rα and/or Rγc. A dual receptor binding compound can comprise one or more linear or branched dual receptor binding ligands comprising one or more IL-2Rβ ligands, one or more IL-7Rα ligands, and one or more Rγc ligands. The presence of multiple IL-2Rβ ligands, IL-7Rα ligands and/or Rγc ligands can preferentially increase the potency of an IL-2R agonist and/or IL-7R agonist on cells that highly express IL-2Rβ, IL-7Rα and/or Rγc compared to cells having low expression levels of IL-2Rβ, IL-7Rα and/or Rγc.

A dual receptor binding compound can comprise a moiety having an additional pharmacological activity other than that mediated by activation of the IL-2 receptor and/or the IL-7 receptor. The pharmacological activity can be an activity that has a therapeutic efficacy that is synergistic with that of IL-2R and/or IL-7R agonist or antagonist activity or the pharmacological activity can be an activity that has a therapeutic efficacy that is not synergistic with that of the IL-2R and/or IL-7R agonist or antagonist activity. Examples of suitable pharmacological moieties include antibodies and antibody fragments that are inhibitors of checkpoint molecules, pro-apoptotic and anti-apoptotic molecules, cytotoxic molecules, agonists of chemokine, antagonists of chemokine, cytokine, growth factor and other cell surface receptors, and ligands and inhibitors of cell surface adhesion molecules such as integrins.

One or more ligands provided by the present disclosure can be bound to a molecule comprising a targeting moiety that confers the ability to target the one or more dual ligands to specific tissues or cells in a patient. A targeting moiety can have an affinity for a cell-surface protein or receptor expressed on the surface of a target tissue or target cell, and thereby can direct a dual ligand to the target tissue or cell. Examples of targeting moieties include antigen binding moieties including antibodies and fragments thereof specific for cell surface proteins, ligands, biological receptors, and antigens.

An antibody can bind to an antigen expressed on the surface of the target cell type. The antibody may not have any useful or known useful pharmacologic function but serves to direct a dual receptor binding construct to preferentially target a cell type or tissue compared to cell types or tissues not expressing the targeted antigen or having an expression level of the targeted antigen less than that of the targeted cell type or tissue. An antibody can have a useful pharmacological function when bound to a cell surface antigen. These constructs are referred to as dual pharmacology dual receptor binding constructs.

A dual receptor binding construct can comprise one or more targeting moieties such as one or more antigens. For example, a dual receptor binding fusion protein can comprise one or more antigen binding moieties. The two more antigen binding moieties can be directed to the same antigen or to different antigens.

A targeting moiety can bean antigen binding moiety and the dual receptor binding fusion protein can be an immunoconjugate. The immunoconjugate can comprise one or more antigen binding moieties capable of binding to an antigen expressed on a cell surface, on the surface of virus-infected cells on the surfaces of diseased cells in the blood serum, and/or in the extracellular matrix.

An antigen binding moiety can comprise an antibody or an antibody fragment. The antigen binding moiety can be an immunoglobulin molecule such as, for example, an IgG class immunoglobulin, including an IgG1, IgG2, or IgG4 isotype. A ligand can be bound to one or both of the heavy chains such as at the C-terminus of the CH3 domain. An antigen binding moiety can be a Fab molecule, an scFv molecule, or a peptide.

An antigen binding moiety can be directed to any specific antigen such as, for example, an antigen expressed on the surface of a tumor cell or in a tumor cell environment, an antigen expressed on an immune cell, an antigen expressed on the surface of a cell expressing predominantly the IL-7Rα and Rγc subunits of IL-7R such as CD4+ T-cells, CD8+ T-cells, or NK cells.

Examples of suitable antigen targets expressed on tumor cells include fibroblast activation protein (FAP), the A1 domain of tenascin-C (TNC A1), the A2 domain of tenascin-C (TNC A2), the extradomain B of fibronectin (EDB), carcinoembryonic antigen (CEA), and melanoma-associated chondroitin sulfate proteoglycan (MCSP).

Other examples of suitable tumor antigens that can be used for targeting include MAGE, MART-1/Melan-A, gplOO, Dipeptidyl peptidase IV (DPPIV), adenosine deaminase-binding protein (ADAbp), cyclophilin b, Colorectal associated antigen (CRC)-0017-A/GA733, Carcinoembryonic Antigen (CEA) and its immunogenic epitopes CAP-1 and CAP-2, etv6, amll, Prostate Specific Antigen (PSA) and its immunogenic epitopes PSA-1, PSA-2, and PSA-3, prostate-specific membrane antigen (PSMA), T-cell receptor/CD3-zeta chain, MAGE-family of tumor antigens (e.g., MAGE-A1, MAGE-A2, MAGE-A3, MAGE-A4, MAGE-AS, MAGE-A6, MAGE-A7, MAGE-AS, MAGE-A9, MAGE-AlO, MAGE-All, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4, MAGE-CS), GAGE-family of tumor antigens such as GAGE-I, GAGE-2, GAGE-3, GAGE-4, GAGE-5, GAGE-6, GAGE-7, GAGE-8, GAGE-9, BAGE, RAGE, LAGE-I, NAG, GnT-V, MUM-1, CDK4, tyrosinase, p53, MUC family, HER2/neu, p2iras, RCAS1, a-fetoprotein, E-cadherin, a-catenin, -catenin and y-catenin, pl20ctn, gplOO Pmel117, PRAME, NY-ES0-1, cdc27, adenomatous polyposis coli protein (APC), fodrin, Connexin 37, Ig-idiotype, p15, gp75, GM2 and GD2 gangliosides, viral products such as human papilloma virus proteins, Smad family of tumor antigens, lmp-1, PIA, EBY-encoded nuclear antigen (EBNA)-1, brain glycogen phosphorylase, SSX-1, SSX-2 (HOM-MEL-40), SSX-, SSX-4, SSX-5, SCP-1 and CT-7, and cerbB-2.

Examples of viral antigens include influenza virus hemagglutinin, Epstein-Barr virus LMP-1, hepatitis C virus E2 glycoprotein, HIV gp160, and HIV gp120.

Examples of ECM antigens include syndecan, heparanase, integrins, osteopontin, link, cadherins, laminin, laminin type EGF, lectin, fibronectin, notch, tenascin, and matrixin.

Targeted dual receptor binding compounds such as dual receptor binding fusion proteins can be configured to bind, for example, to a cell surface antigen selected from FAP, Her2, EGFR, IGF-R, CD2 (T-cell surface antigen), CD3 (heteromultimer associated with the TCR), CD22 (B-cell receptor), CD23 (low affinity IgE receptor), CD30 (cytokine receptor), CD33 (myeloid cell surface antigen), CD40 (tumor necrosis factor receptor), IL-6R (IL6 receptor), CD20, MCSP, and PDGFR (platelet-derived growth factor receptor).

A targeted dual receptor binding construct can comprise an antigen binding moiety capable of binding to an antigen or a receptor expressed by a cell that expresses the IL-2Rβ and Rγc subunits of IL-2R, and IL-7Rα and Rγc subunits of IL-7R. Examples of cells expressing the IL-7Rα and Rγc subunits of IL-7R include, for example, naïve T-cells, memory T-cells, and activated T-cells such as CD4+ T-cells, and CD8+ T-cells.

Examples of antigens expressed on the surface of naïve CD4+ T-cells include CD4+, CD45RA+, CD45RO−, CCR7+, and CD25.

Examples of antigens expressed on the surface of naïve CD8+ T-cells include CD8+, CD45RA+, CD45O+, CCR7+, and CD28+.

Examples of antigens expressed on the surface of CD4+ T-cells include Th1 cell markers such as CD4+, CXCR3+, CCR5+, and IL12Rβ2+; Th2 cell markers such as CD4+, CCR4+, and IL12Rβ2+; Th9 cell markers such as CD4+, CCR3+, and CCR5+; Th17 cell markers such as CD4+, CCR6+, CCR4+, and NK1.1+; Th22 cell markers such as CD4+, CCR10+, CCR4+, and CCR6+; Treg cell markers such as CD4+, CD127+, CD24+, and CTLA-4+; and Tfh cell markers such as CD4+, CXCR5+, CD40L+, and ICOS+.

Examples of antigens expressed on the surface of cytotoxic CD8+ T cell include CD8+ and CCR7−.

Examples of memory T-cell antigens include CCR5, CCR7, CD11a, CD27, CD28, CD45RA, CD45RO, CD57, and/CD62.

Examples of naïve T-cell antigens include CD45RA, CCR7, CD62L, CD127, and CD132.

A targeted dual receptor binding construct can comprise an antigen binding moiety capable of binding to an antigen or receptor expressed on the surface of cells having a role in regulating the immune response.

Examples of antigens expressed by cells associated with regulating the immune response include PD-1, CTLA-4, CD20, and CD30.

A targeted dual receptor binding construct can comprise an antigen binding moiety capable of binding to an antigen or receptor expressed on the surface of Treg cells such as CD25. For example, a Treg cell-targeted construct can comprise a dual ligand/daclizumab antibody fusion.

A dual pharmacology dual receptor binding construct provided by the present disclosure can comprise a ligand provided by the present disclosure and a pharmacological moiety. A pharmacological moiety can exert a therapeutic effect on cells expressing IL-2R and IL-7R or on cells other than those expressing IL-2R and IL-7R. One or more ligands can be linked to a biological agent including therapeutic compounds such as, for example, antineoplastic agents, anti-microbial agents, hormones, immunomodulators, and anti-inflammatory agents.

A dual pharmacology dual receptor binding construct can comprise, for example, a protein such as an antibody. An antibody can be an IgA isotype, IgD isotype, IgE isotype, IgG isotype, or IgM isotype. A dual pharmacology dual receptor binding construct can comprise a ligand coupled to a pharmacologically active antibody through a linker. The linker can be a naturally occurring molecule or a synthetic molecule.

A dual pharmacology dual receptor binding construct can comprise an antibody having an antigen binding moiety and one or more IL-2Rβγc ligands and IL-7Rαγc ligands or one or more dual receptor binding ligands bound to the Fc chain through an Fc linker.

An antibody can comprise an antibody directed to a cell-specific antigen. Examples of antibodies directed to cell-specific antigens include alemtuzumab (CD52 antigen), trastuzumab (Her2 protein), ibritumomab tiuxetan (CD20 antigen), brentuximab vedotin (CD30 antigen), ado-trastuzumab emtansine (Her2 protein), blinatumomab (CD19 protein and CD3 protein).

A dual pharmacology dual receptor binding construct can comprise a moiety known to be useful in treating cancer. Examples of monoclonal antibodies known to be useful in treating cancer include alemtuzumab, atezolizumab, avelumab, bevacizumab, brentuximab, cemiplimab cetuximab, trastuzumab, denosumab, rituximab, ipilimumab, nivolumab, obinutuzumab, ofatumumab, panitumumab, pembrolizumab, pertuzumab, rituximab, and trastuzumab.

A dual pharmacology dual receptor binding construct can comprise a moiety known to be a checkpoint inhibitor such as CTLA-4 inhibitors, PD-1 inhibitors, PD-L1, and PD-L2 inhibitors.

Examples of suitable PD-1 inhibitors include nivolumab, cemiplimab, and pembrolizumab; examples of CTLA-4 inhibitors include ipilimumab; and examples of PD-L1 inhibitors include atezolizumab and durvalumab.

Examples of monoclonal antibodies useful in treating autoimmune and inflammatory diseases include abciximab, adalimumab, alefacept, alemtuzumab, basiliximab, belimumab, bezlotuxumab, canakinumab, certolizumab, daclizumab, denosumab, efalizumab, golimumab, inflectra, ipilimumab, ixekizumab, natlizumab, nivolumab, olaratumab, amalizumab, palivizumab, panitumumab, pembrolizumab, rituximab, tocilizumab, trastuzumab, secukinumab, and ustekinumab.

A dual pharmacology dual ligand antibody construct can comprise an antibody to a checkpoint inhibitor. Antibodies to checkpoint inhibitors include CTLA-4 blockade blocking antibodies, PD-1 inhibitors such as nivolumab, pembrolizumab, and spartalzumab; PD-L1 inhibitors such as atezolizumab; and other antibodies targeting intrinsic checkpoint blockades such as CISH.

Suitable FDA-approved antibody checkpoint inhibitors include ipilimumab (CTLA-4), nivolumab (PD-1), pembrolizumab (PD-1), atezolizumab (PD-1), avelumab (PD-1), durvalumab (PD-1), and cemiplimab (PD-1).

A dual pharmacology dual receptor binding construct can comprise a cytokine fusion. A dual receptor binding cytokine construct can comprise one or more ligands and one or more cytokines bound to a naturally occurring or synthetic molecule. For examples, one or more ligands and one or more cytokines can be bound to a polypeptide or to a protein such as an IgG or an Fc-fragment. A cytokine can be selected from, for example, an interleukin, a chemokine, a colony-stimulating factor, an interferon, a transforming growth factor, and a tumor necrosis factor.

A dual receptor binding construct provided by the present disclosure can comprise a virology construct. A dual receptor binding virology construct can comprise a ligand provided by the present disclosure to protein expressed on the surface of a virus, an antigen expressed on the surface of a cell targeted by the virus, a cell surface antigen targeted by the virus, or a virus-like particle, or a vaccine.

Certain dual receptor binding compounds provided by the present disclosure can be synthesized using recombinant DNA technology.

Certain dual receptor binding compounds provided by the present disclosure can be synthesized using synthetic organic chemistry methods.

Dual receptor binding compounds provided by the present disclosure are agonists of IL-2R and IL-7R.

A dual receptor binding compound can bind to the IL-2Rβ subunit and to the Rγc subunit of IL-2R and can activate IL-2R and can bind to the IL-7Rα subunit and to the Rγc subunit of IL-7R and can activate IL-7R. A dual receptor binding compound can independently bind to the IL-2Rβ subunit, the IL-7Rα subunit and to the Rγc subunit with an $IC_{50}$, for example, of less than 100 µM, less than 10 µM, less than 1 µM, less than 100 nM, less than 10 nM, or less than 1 nM.

A dual receptor binding compound can bind to the IL-2Rβ subunit, to the IL-7Rα subunit and/or to the Rγc subunit with an $IC_{50}$, for example, of less than 100 µM, less than 10 µM, less than 1 µM, less than 100 nM, less than 10 nM, or less than 1 nM. A dual receptor binding compound can bind to the IL-2Rβ subunit and to the Rγc subunit either competitively or non-competitively with IL-2, and to the IL-7Rα subunit and to the Rγc subunit either competitively or non-competitively with IL-7.

A dual receptor binding compound can be configured to more potently activate cells expressing the IL-2Rβ subunit, the IL-7Rα subunit and the Rγc subunit, thereby facilitating the ability to differentially activate IL-2R and IL-7R expressed on the surface of different cell types by controlling a dose of a ligand agonist or dual ligand construct agonist. For example, when incubated with a dual receptor binding compound, primary human peripheral blood mononuclear cells (PBMC) expressing the IL-2Rβ, IL-7Rα, and Rγc subunits phosphorylate signal transducer and activator of transcription 5 (STAT5).

The $EC_{50}$ for STAT5 phosphorylation in TF-1-7α or hPMBCs induced by a dual receptor binding compound can be, for example, less than 100 µM, less than 10 µM, less than 1 µM, less than 100 nM, less than 10 nM, or less than 1 nM.

The $EC_{50}$ for STAT5 phosphorylation in TF-1-7α cells induced by a dual receptor binding compound can be, for example, within a range from 1 pM to 100 µM, from 10 pM to 10 µM, or from 100 µM to 1 µM.

A dual receptor binding compound provided by the present disclosure can activate the STAT5 phosphorylation pathway, the AKT phosphorylation pathway, and the ERK1/2 phosphorylation pathway in CD4+ and CD8+ cells.

A dual receptor binding compound can partially activate IL-2R and IL-7R. Partial activation refers to a level of activation, that is, for example, less than 75% of maximum activation, less than 50%, less than 25%, less than 10%, or less than 1% of the maximum activation. Maximum activation ($E_{max}$) of IL-2R and IL-7R refers to the amplitude of cellular signal (activation) achievable at high agonist concentration such as a high concentration of IL-2 and IL-7, respectively. Partial IL-2R and IL-7R agonists can be effective in modulating the levels of response of IL-2R and IL-7R to activation of the IL-2Rβ, IL-7Rα, and Rγc subunits among different cell types expressing IL-7R. For example, different cell types are known to vary in expression levels of each of the IL-2R subunits, IL-2Rβ and Rγc, and each of the IL-7R subunits, IL-7Rα and Rγc, and to exhibit different sensitivities to IL-2R agonists and IL-7R agonists.

A dual receptor binding compound can comprise modified IL-2Rβ ligands, modified IL-7Rα ligands, and/or modified Rγc ligands. Modified IL-2Rβ, IL-7Rα and Rγc ligands can be selected or designed to bind and to activate IL-2R and/or IL-7R, but with low or modest affinity and potency to IL-2R and/or IL-7R. Such ligands and dual ligand constructs can have greater differential sensitivity for IL-2R and IL-7R activation between cells that highly express IL-2Rβ and IL-7Rα and cells having a low level of IL-2Rβ and IL-7Rα expression.

A dual receptor binding compound provided by the present disclosure can act as full IL-2R and IL-7R agonists, partial IL-2R and IL-7R agonists, biased IL-2R and IL-7R agonists, or IL-2R and IL-7R antagonists.

As shown in Example 41, a dual receptor binding compound can act as a full agonist on both IL-2R and IL-7R with respect to STAT5 phosphorylation in TF-1β and TF-1 IL-7Rα (TF-1-7a) cells and in resting human PMBCs.

As shown in Example 42, with respect to STAT5 phosphorylation in TF-1β cells and TF-1 IL-7Rα cells and in resting human PMBCs, a dual receptor binding compound provided by the present disclosure can exhibit partial agonist activity.

A dual receptor binding compound provided by the present disclosure can act as IL-2R and IL-7R antagonists. A dual receptor binding compound that acts as an antagonist can bind to IL-2R and to IL-7R with an $IC_{50}$, for example, of less than 100 µM, less than 10 µM, less than 1 µM, less than 0.1 µM, or less than 0.01 µM and exhibits no detectable functional activity as determined, for example, using any of the functional assays disclosed in the examples such as the STAT5 phosphorylation assay.

A dual receptor binding compound provided by the present disclosure can be incorporated into pharmaceutical compositions to be administered to a patient by any appropriate route of administration including intradermal, intramuscular, intraperitoneal, intravenous, subcutaneous, intranasal, epidural, oral, peroral, sublingual, intracerebral, intravaginal, transdermal, rectal, inhalation, or topical. A pharmaceutical composition provided by the present disclosure can be an injectable formulation. Pharmaceutical compositions provided by the present disclosure can be injectable intravenous formulations. Pharmaceutical compositions provided by the present disclosure can be oral formulations. Oral formulations may be oral dosage forms. A pharmaceutical composition may be formulated for intravenous administration or for subcutaneous administration.

Pharmaceutical compositions provided by the present disclosure may comprise a therapeutically effective amount of a dual receptor binding compound together with a suitable amount of one or more pharmaceutically acceptable vehicles so as to provide a composition for proper administration to a patient. Suitable pharmaceutical vehicles and methods of preparing pharmaceutical compositions are described in the art.

Accordingly, it is within the capability of those of skill in the art to assay and use dual receptor binding compounds and/or pharmaceutical compositions thereof for therapy.

A dual receptor binding compound and/or pharmaceutical composition thereof can generally be used in an amount effective to achieve the intended purpose. For example, a dual receptor binding compound and/or pharmaceutical composition thereof, can be administered to a patient in a therapeutically effective amount to treat a disease such as cancer, an autoimmune disease or an inflammatory disease.

The amount of a dual receptor binding compound and/or pharmaceutical composition thereof that will be effective in the treatment of a particular disorder or condition disclosed herein will depend in part on the nature of the disorder or condition, and can be determined by standard clinical techniques known in the art. In addition, in vitro or in vivo assays may optionally be employed to help identify optimal dosage ranges. A suitable amount of a dual receptor binding compound and/or a pharmaceutical composition thereof administered can depend on, among other factors, the patient being treated, the weight of the patient, the severity of the affliction, the manner of administration and the judgment of the prescribing physician.

A dual receptor binding compound can be assayed in vitro and in vivo, for the desired therapeutic activity, prior to use in humans. For example, in vitro assays may be used to determine whether administration of a specific dual receptor binding compound or a combination of dual receptor binding compounds is preferred. The dual receptor binding compounds can also be demonstrated to be effective and safe using animal model systems.

In certain embodiments, a therapeutically effective dose of a dual receptor binding compound and/or pharmaceutical composition thereof will provide therapeutic benefit without causing substantial toxicity. Toxicity of a dual receptor binding compound and/or a pharmaceutical composition thereof may be determined using standard pharmaceutical procedures and may be readily ascertained by the skilled artisan. The dose ratio between toxic and therapeutic effect is the therapeutic index. A dual receptor binding compound and/or a pharmaceutical composition thereof can exhibit a high therapeutic index in treating disease and disorders. A dose of a dual receptor binding compound and/or pharmaceutical composition thereof will be within a range of circulating concentrations that include an effective dose with minimal toxicity.

A dual receptor binding compound provided by the present disclosure or a pharmaceutical composition thereof may be included in a kit that may be used to administer the compound to a patient for therapeutic purposes. A kit can include a pharmaceutical composition comprising a dual receptor binding compound provided by the present disclosure suitable for administration to a patient and instructions for administering the pharmaceutical composition to the patient. The kit can be used for treating cancer, for treating an autoimmune disease, or for treating an inflammatory disease. A kit for use in treating cancer in a patient can comprise a dual receptor binding compound provided by the present disclosure, a pharmaceutically acceptable vehicle for administering the dual receptor binding compound, and instructions for administering the dual receptor binding compound to a patient.

The pharmaceutical compositions can be included in a container, pack, or dispenser together with instructions for administration.

Instructions supplied with a kit may be printed and/or supplied, for example, as an electronic-readable medium, a video cassette, an audiotape, a flash memory device, or may be published on an internet web site or distributed to a patient and/or health care provider as an electronic communication.

A dual receptor binding compound provided by the present disclosure can be useful when combined with certain vaccines, including cancer neo-antigen vaccines. Mutations in tumor DNA produces new protein sequences that are foreign to the body. Vaccines can be designed to specifically activate a patient's immune system with respect to tumor-specific neo-antigens. When administered in combination with a neo-antigen vaccine, a dual receptor binding compound provided by the present disclosure can expand and proliferate neo-antigen-specific T-cells in the tumor microenvironment and thereby drive maximal expansion of vaccine-induced neo-antigen-specific T-cells for the treatment of cancer.

A dual receptor binding compound provided by the present disclosure can be used as an adjuvant. An adjuvant refers to a compound that enhances the efficacy of a vaccine without directly participating in the protective immunity. For example, a dual receptor binding compound provided by the present disclosure can be used in conjunction with a cancer vaccine or a viral vaccine.

Recent research suggests that IL-7 can serve as an effective vaccine adjuvant. For example, IL-7R$\alpha$ is expressed on the majority of resting, naïve CD8+ T cells; IL-7 signaling recruits T cells specific for low-affinity antigens into the proliferative pool in lymphopenic hosts; and, as with other R$\gamma$c cytokines, IL-7 prevents programmed cell death. Because IL-7 is important during the expansion and development of effector T-cells into memory T-cells, it is reasonable that IL-7 could be used to stimulate the development and expansion of effector T cells during vaccination.

Administration of IL-7 has been shown therapeutic potential for augmenting the immune response and can enhance the effectiveness of vaccine-induced T cell responses.

For example, co-delivery of hIL-7 DNA augmented multigenic HCV DNA vaccine-induced T cell responses in a non-human primate model.

In bacterial infections, therapeutic potential of IL-7 in the setting of sepsis mouse model was proven by increasing the number of recruited neutrophils.

Therapies involving administration of IL-7 showed enhanced virus-specific T cell responses which led to viral clearance in a chronic lymphocytic choriomeningitis (LCMV) mouse infection model. Administration of recombinant IL-7 during the contraction phase of CD8+ T cell responses elicited in response to DNA vaccines increased the number of LCMV-specific memory T-cells.

In a murine model of influenza A virus (IAV) it was demonstrated that a single intranasal pretreatment with Fc-fused IL-7 (IL-7-mFc), but not a native form of IL-7, protected mice from IAV-induced mortality for an extended period of time, even without preexisting IAV-specific immunity. IL-7-mFc treatment induced altered immune environments in the lung, with prolonged occupancy of lung-retentive effector/memory phenotype T (TRM-like) cells, which play an essential role in protection from IAVs by limiting viral replication and immunopathology, while helping IAV-specific cytotoxic T lymphocytes (CTLs) to propagate.

In another study, in which a recombinant RABV (rRABV) that expressed mouse IL-7 was administered to mice, it was found that overexpressing IL-7 improved the production of long-lasting primary and secondary antibody responses to RABV infection.

It has been reported that recombinant IL-7 protein enhances the survival of *Mycobacterium tuberculosis*-infected mice by the activation of antigen-specific effector CD8+ T cells.

Furthermore, IL-7-expressing plasmids can enhance vaccine-induced CTL and/or Th2-type immune responses in mice injected with HSV-2 gD DNA vaccine.

In another study a DNA vaccine encoding the VP1 capsid protein of foot and mouth disease virus was co-delivered to mice with an IL-6 expressing plasmid as an initial adjuvant and boosted with an IL-7 expressing plasmid as a secondary adjuvant. Mice immunized with pVAX-IL-6 and boosted with pVAX-IL-7 produced the highest expression of CD44high CD62Llow in activated CD4+ T cells.

A dual receptor binding compound provided by the present disclosure can be useful for cell therapy when engineered to be expressed on the membrane surface of cells that also express the IL-2Rβ, IL-7Rα, and Rγc subunits. Adoptive immunotherapy using NK cells or using re-targeted chimeric antigen receptor (CAR) T-cells is currently being studied as a treatment for neoplasms and viral infections. One challenge with these cell therapies is the suboptimal sustained survival of the infused cells.

DNA encoding a ligand fused to a membrane protein in such away that the dual receptor binding compound is expressed on the extracellular surface of a cell can be constructed using standard techniques. When a fusion protein comprising an IL-2Rβγc ligand, an IL-7Rγc ligand, and/or a dual receptor binding ligand is expressed, IL-2 receptors and IL-7 receptors on the cell become activated leading to long-term persistence of the cell.

DNA encoding a ligand can be incorporated into a cell and can be configured to produce a dual receptor binding provided by the present disclosure. A dual receptor binding compound can be secreted from the cell and can interact with the secreting cells (i.e., autocrine signaling) and/or cells in the vicinity of the secreting cell (i.e., paracrine signaling). A secreted dual receptor binding compound provided by the present disclosure can be an IL-2R agonist and IL-7R agonist and can be designed to localize near the secreting cell.

A dual receptor binding provided by the present disclosure can be used to expand T-cells within a patient or within a biological sample. Methods of increasing the ratio of non-regulatory T-cells to Treg cells can comprise contacting a population of T-cells with an effective amount of a dual receptor binding. The ratio can be measured by determining the ratio of CD3+FOXP3+ cells to CD3+FOXP3-cells within the population of T-cells. A typical Treg frequency in human blood is 5% to 10% of the total CD4+CD3+ T-cells, however, in certain diseases this percentage may be lower or higher.

A dual receptor binding may be used to expand T-cells. T-cells modified with chimeric antigen receptors (CARs), which redirect immune cell activity to target cancer cells have been demonstrated to exhibit improved antitumor responses. CARs can comprise an antibody-derived extracellular domain, which binds to the desired tumor-associated antigen (TAA) and triggers an intracellular signaling cascade to activate the immune cell against the target cells.

A dual receptor binding that are immobilized to a surface can be exposed to populations of T-cells in vitro or ex vivo to induce expansion of the cell population. Prior to transfer to a patient. CAR-T cells can be expanded by exposure to an immobilized form of a dual receptor binding. An immobilized dual receptor binding can be separated from the CAR-T cells prior to transfer of the CAR-T cells to a patient.

CAR T-cells can be genetically engineered to co-express a tethered form of a dual receptor binding provided by the present disclosure to support in vivo persistence and maintenance of an immature state of differentiation and to exhibit in vivo antitumor activity.

Assessing single patient response to therapy and qualifying a patient for optimal therapy are among the greatest challenges of modern healthcare and relate to trends in personalized medicine. Dual receptor binding compounds can have target selectivity, for example, for certain cancers and immune cells. Dual receptor binding compounds radiolabeled for positron emission tomography (PET) or Single Photon Emission Computed Tomography (SPECT) can be used to predict the targeting of the treatment based on a single-study, case-by-case patient analysis thus excluding patients that are expected not to benefit from treatment. PET/SPECT scans using dual receptor binding compounds, once correlated to the concentration can provide a three-dimensional distribution map, which can then be used for dose calculations.

A dual receptor binding compound can comprise one or more imaging agents. A dual receptor binding compound can direct and localize the compound to cells, populations of cells, and tissue expressing IL-2R and IL-7R. The imaging compounds can comprise one or more imaging agents such as radiolabels, fluorescent labels, enzymatic labels, or PET imaging agents.

The imaging agents can be used to determine the number of cells expressing IL-2R and IL-7R, the expression level of cells expressing IL-2R and IL-7R, or properties of IL-2R and IL-7R such as the binding affinity of a particular dual receptor binding compound to IL-2R and/or to IL-7R. The imaging agents can be used, for example, to evaluate cancer cells expressing the IL-2Rβ subunit, the IL-7Rα subunit, and the Rγc subunit, or to evaluate Treg and/or Teff cells.

The label can be detected to determine a biodistribution of the compound in a patient or to assess the potential for therapeutic efficacy. For example, tumors expressing high levels of IL-2R and IL-7R may be attractive targets for therapeutic dual receptor binding compounds provided by the present disclosure.

The imaging agents can be used to evaluate cells expressing IL-2R and IL-7R before therapy, during therapy, and/or following therapy.

Imaging agents comprising a ligand can further comprise a moiety capable of binding to a cell surface and in particular to a protein expressed on the cell surface. The protein can be indicative of a certain cell type and is referred to as a cell surface marker. Imaging agents comprising both a ligand and a cell surface marker can be used to assess cells, a population of cells, and/or a tissue expressing IL-2R, IL-7R and the cell surface marker. Assessment can include determining the number of cells expressing IL-2R, IL-7R and the cell surface marker, the expression levels of IL-2R, IL-7R and the cell surface marker, and/or the binding affinity of the imaging agent to IL-2R, to IL-7R and/or to the cell surface marker.

The imaging agents can be used to evaluate cells expressing IL-2R and IL-7R and the cell surface marker before therapy, during therapy, and/or following therapy.

Dual receptor binding compounds provided by the present disclosure can be labeled. Labeled compounds can be useful in diagnostics.

Dual receptor binding compounds provided by the present disclosure can be labeled with a detectable marker. The label can be used to determine a biodistribution of the compound in a patient or to assess the potential for therapeutic efficacy. For example, tumors expressing high levels of IL-2R and IL-7R may be attractive targets for selective IL-2R and IL-7R agonists and dual receptor binding compounds provided by the present disclosure.

Dual receptor binding compounds provided by the present disclosure include labeled compounds. A labeled compound can be a detectable marker, for example, a radiolabeled amino acid or an attachment of biotinyl moieties to a polypeptide, wherein the attached biotinyl moieties can be detected by marked avidin such as streptavidin containing a fluorescent marker or enzymatic activity that can be detected by optical or colorimetric methods. Various methods of labeling polypeptides and glycoproteins are known in the art and may be used. Examples of labels for polypeptides include, for example, a radioisotope such as, $^3H$, $^{14}C$, $^{35}S$, $^{125}I$, and $^{131}I$, a fluorescent labels such as FITC, rhodamine, and lanthanide phosphors, an enzymatic label such as horseradish peroxidase, 0-galactosidase, luciferase, and alkaline phosphatase, biotinyl groups, predetermined polypeptide epitopes recognized by a secondary reporter such as leucine zipper pair sequences, binding sites for secondary antibodies, metal ligands, and epitope tags. A label can be attached by spacer arms of various lengths to reduce potential steric hindrance.

Dual receptor binding compounds can comprise a cell-specific targeting moiety or molecule.

A cell-specific targeting moiety can comprise a moiety that has an affinity for a component on the surface of a cell such as a receptor, a protein, or an epitope. A targeting moiety can comprise, for example, a ligand or an antibody having an affinity to a cell surface component.

A targeting moiety can direct and concentrate compounds comprising a dual receptor binding compound at the cells, population of cells, or tissue targeted by the targeting moiety.

A targeting moiety can enhance the potency of IL-2R and IL-7R agonism or IL-2R and IL-7R antagonism for the cells or population of cells being targeted.

A targeting moiety can provide a differential response to IL-2R and IL-7R agonism or to IL-2R and IL-7R antagonism between the cells being targeted and the cells not being targeted by the targeting moiety.

A targeting moiety can provide a differential response to IL-2R and IL-7R agonism or IL-2R and IL-7R antagonism between cells having a high expression level of the targeted component and cells having a lower expression level of the targeted component.

A dual receptor binding compound can further comprise a bioactive moiety or a bioactive molecule. A dual receptor binding compound can be used to deliver the bioactive moiety or bioactive molecule to cells, to a population of cells, or to a tissue expressing the IL-2Rβ subunit, the IL-7Rα subunit, and the Rγc subunit.

The bioactive moiety or molecule can be non-cleavable and capable of exerting a biological activity when bound to a dual receptor binding compound.

The bioactive moiety or molecule can be cleavable. The moiety can be cleavable by any suitable mechanism such as by pH, enzymatic, thermal, and/or electromagnetic mechanisms. Electromagnetic mechanisms include, for example, exposing the compounds to infrared, visible, or ultraviolet radiation, where the bioactive moiety is attached to the compounds comprising a ligand through a photolabile moiety capable of being cleaved by the radiation.

The bioactive molecule can be non-cleavable but otherwise activatable, such as for example, activatable by exposure to electromagnetic radiation.

Ligands can be selected to have enhanced binding to the IL-2Rβ, IL-7Rα and/or Rγc subunit at a certain pH. For example, a pH-selective ligand can have a greater binding affinity to the IL-2Rβ, IL-7Rα and/or Rγc subunit at low pH commensurate with that of a solid tumor microenvironment. Dual receptor binding compounds comprising low-pH selective ligands can be used to preferentially activate cells in low pH environments expressing the IL-2Rβ subunit, the IL-7Rα subunit and the Rγc subunit compared to cells in normal pH environments associated with healthy tissue.

Thus, dual receptor binding compounds comprising selective IL-2Rβ, IL-7Rα and/or Rγc ligands such as pH-selective IL-2Rβ, IL-7Rα and/or Rγc ligands can be used with other pH-selective bioactive moieties and molecules.

A bioactive moiety or bioactive molecule can itself be selective for a particular cell population. For example, a bioactive moiety or bioactive molecule can exhibit a greater or lesser binding affinity, potency, and/or activity at the cell being targeted by a selective ligand. For example, the bioactive moiety or molecule can exhibit greater bioactivity in a low pH tumor microenvironment when targeted by a pH-selective ligand. In this example, the bioactive moiety is directed to cells located in the low-pH tumor microenvironment that express the IL-2Rβ and IL-7Rα subunit by the pH-selective ligand. Thus, the activity of the pH-selective bioactive moiety is enhanced in the low-pH tumor microenvironment.

A dual receptor binding compound can further comprise a cytotoxic moiety or cytotoxic molecule. Such compounds can be used to deliver a cytotoxic moiety or compound to a cell expressing the IL-7Rα subunit such as T-cells. The cytotoxic moiety or molecule can exert cytotoxicity when bound to the compound or can be cleavable and the moiety or molecule can be cytotoxic when released from the compound; or the cytotoxic moiety can be activated by electromagnetic radiation.

The cytotoxic moiety or molecule can be used to deplete cells expressing the IL-2Rβ subunit and the IL-7Rα subunit being targeted.

Cytotoxic dual receptor binding compounds can have more than one Il-2Rβγc ligand, more than one IL-7Rγc ligand, and/or more than one dual receptor binding ligand and thereby can exhibit a higher affinity and/or selectivity to cells, populations of cells, and tissue that highly expresses the IL-2Rβ and IL-7Rα subunits compared to cells having a lower expression level of the IL-2Rβ and IL-7Rα subunits.

Cytotoxic dual receptor binding compounds can further include a cell surface targeting component. Such cytotoxic compounds can exhibit enhanced efficacy to cells, populations of cells, and tissue expressing the IL-2Rβ and IL-7Rα subunits and the surface target component.

Examples of suitable cytotoxic molecules include antimicrotubule agents, alkylating agents, and DNA minor groove binding agents.

A dual receptor binding compound provided by the present disclosure can be used, for example, to treat diseases such as cancer, an inflammatory disease, an autoimmune disease, an immunodeficiency or an infectious disease, including a viral disease such as COVID-19.

A dual receptor binding compound provided by the present disclosure and pharmaceutical compositions of any of the foregoing may be administered to a patient to treat an organ transplant.

A dual receptor binding compound provided by the present disclosure and pharmaceutical compositions of any of the foregoing may be administered to a patient together with another compound for treating an inflammatory disease or an autoimmune disease in the subject. The at least one other therapeutic agent may be a dual receptor binding compound provided by the present disclosure. A dual receptor binding compound and the at least one other therapeutic agent may act additively or synergistically. The at least one additional therapeutic agent may be included in the same pharmaceutical composition or vehicle comprising the dual receptor binding compound or may be in a separate pharmaceutical composition or vehicle. Accordingly, methods provided by the present disclosure further include, in addition to administering a dual receptor binding compound, administering one or more therapeutic agents effective for treating an inflammatory disease or an autoimmune disease or a different disease, disorder or condition than an inflammatory disease or an autoimmune disease. Methods provided by the present disclosure include administration of a dual receptor binding compound and one or more other therapeutic agents provided that the combined administration does not inhibit the therapeutic efficacy of a dual receptor binding compound and/or does not produce adverse combination effects.

A dual receptor binding compound provided by the present disclosure comprise treating a disease in a patient such as cancer, an inflammatory disease, or an autoimmune disease comprising administering to a patient in need thereof a therapeutically effective amount of a compound capable of binding to the specific binding site of the IL-2Rβ subunit and/or the Rγc subunit of IL-2R with an $IC_{50}$ of less than 100 µM, less than 10 µM, less than 1 µM, less than 100 nM, or less than 10 nM and binding to the specific binding site of the IL-7Rα subunit and/or the Rγc subunit of IL-7R with an $IC_{50}$ of less than 100 µM, less than 10 µM, less than 1 µM, less than 100 nM, or less than 10 nM.

A dual receptor binding compound provided by the present disclosure may be used for treating cancer in a patient. The cancer can be, for example, a solid tumor or a metastasis.

A dual receptor binding compound provided by the present disclosure or a pharmaceutical composition thereof may be administered to treat a cancer known to be treated by activation of IL-2R and IL-7R. A dual receptor binding compound provided by the present disclosure or a pharmaceutical composition thereof may be administered to treat a cancer known to be treated by activation of the IL-2Rβγc subunits and IL-7Rαγc subunits and where simultaneous activation of the IL-7Rα subunit compromises therapeutic efficacy and/or induces unwanted side effects.

A dual receptor binding compound provided by the present disclosure or pharmaceutical compositions thereof can be used to treat, for example, one or more of the following cancers: acute lymphoblastic leukemia, acute myeloid leukemia, adrenocortical carcinoma, appendix cancer, astrocytoma, atypical teratoid/rhabdoid tumor, basal cell carcinoma (nonmelanoma), B-cell lymphoma, bladder cancer, bone cancer, brain and spinal cord tumors, brain stem cancer, brain tumor, breast cancer, bronchial tumors, Burkitt lymphoma, carcinoid tumor, carcinoma of head and neck, central nervous system embryonal tumors, cerebellar astrocytoma, cerebral astrocytoma/malignant glioma, cervical cancer, chordoma, chronic lymphocytic leukemia, chronic myelogenous leukemia, colorectal cancer, craniopharyngioma, cutaneous T-cell lymphoma, desmoplastic small round cell tumor, ductal carcinoma, dye cancer, endocrine pancreas tumors (islet cell tumors), endometrial cancer, ependymoblastoma, esophageal cancer, esthesioneuroblastoma, Ewing family of tumors, extracranial germ cell tumor, extrahepatic bile duct cancer, gallbladder cancer, gastric cancer, gastrointestinal carcinoid tumor, gastrointestinal stromal tumor, gestational trophoblastic tumor, glioblastoma, glioma, hairy cell leukemia, head and neck cancer, heart cancer, hematopoetic tumors of the lymphoid lineage, hepatocellular cancer, Hodgkin lymphoma, hypopharyngeal cancer, hypothalamic and visual pathway glioma, IDs-related lymphoma, intraocular melanoma, islet cell tumors, Kaposi sarcoma, kidney cancer, Langerhans cell histiocytosis, laryngeal cancer, leukemia, lip and oral cavity cancer, male breast cancer, malignant fibrous histiocytoma, malignant germ cell tumors, malignant mesothelioma, medulloblastoma, melanoma, Merkel cell carcinoma, mesothelioma, mouth cancer, multiple endocrine neoplasia syndrome, multiple myeloma, mycosis fungoides, myelodysplastic, myeloproliferative neoplasms, nasal cavity and paranasal sinus cancer, nasopharyngeal cancer, neuroblastoma, non-Hodgkin lymphoma, non-small cell lung cancer, oral cancer, oropharyngeal cancer, osteosarcoma, ovarian cancer, ovarian epithelial cancer, ovarian germ cell tumor, ovarian low malignant potential tumor, pancreatic cancer, pancreatic neuroendocrine tumors (islet cell tumors), papillomatosis, paraganglioma, paranasal sinus and nasal cavity cancer, parathyroid cancer, penile cancer, pharyngeal cancer, pheochromocytoma, pineal parenchymal tumors, pineoblastoma and supratentorial primitive neuroectodermal tumors, pituitary tumor, plasma cell neoplasm/multiple myeloma, pleuropulmonary blastoma, pregnancy and breast cancer, primary central nervous system lymphoma, primary liver cancer, primary metastatic squamous neck cancer with occult, prostate cancer, rectal cancer, renal cell cancer, renal pelvis and ureter, respiratory tract carcinoma, retinoblastoma, rhabdomyosarcoma, salivary gland cancer, sarcoma, Sézary syndrome, skin cancer, small intestine cancer, soft tissue sarcoma, squamous cell carcinoma (nonmelanoma), stomach cancer, supratentorial primitive neuroectodermal tumors, T-cell lymphoma, testicular cancer, throat cancer, thymoma and thymic carcinoma, thyroid cancer, transitional cell cancer, urethral cancer, uterine sarcoma, vaginal cancer, visual pathway and hypothalamic glioma, vulvar cancer, Waldenström macroglobulinemia, Wilms tumor, and systemic and central metastases of any of the foregoing.

A dual receptor binding compound provided by the present disclosure or pharmaceutical compositions thereof can be used to treat solid tumors.

A dual receptor binding compound provided by the present disclosure or pharmaceutical compositions thereof can be used to treat tumor metastases.

A dual receptor binding compound provided by the present disclosure or pharmaceutical compositions thereof can be used to treat circulating tumor cells.

A dual receptor binding compound provided by the present disclosure or pharmaceutical compositions thereof can be used to treat, for example, a cancer selected from primary adult and childhood brain and CNS cancers including glioblastoma (GBM) and astrocytoma, skin cancers including melanoma, lung cancers including small cell lung cancers, non-small cell lung cancers (NSCLC), and large cell lung cancers, breast cancers including triple negative breast cancer (TNBC), blood cancers including myelodysplastic syndrome (MDS), multiple myeloma (MM), and acute myeloid leukemia (AML), prostate cancer including castrate resistant prostate cancer (CRPC), liver cancers including hepatocellular carcinoma (HCC), esophageal and gastric cancers, and any systemic and central metastases of any of the foregoing.

The amount of a dual receptor binding compound provided by the present disclosure, or a pharmaceutical composition thereof that will be effective in the treatment of a cancer can depend, at least in part, on the nature of the disease, and may be determined by standard clinical techniques known in the art. In addition, in vitro or in vivo assays may be employed to help identify optimal dosing ranges. Dosing regimens and dosing intervals may also be determined by methods known to those skilled in the art. The amount of a dual receptor binding compound provided by the present disclosure administered may depend on, among other factors, the patient being treated, the weight of the patient, the severity of the disease, the route of administration, and the judgment of the prescribing physician.

For systemic administration, a therapeutically effective dose may be estimated initially from in vitro assays. Initial doses may also be estimated from in vivo data, e.g., animal models, using techniques that are known in the art. Such information may be used to more accurately determine useful doses in humans. One having ordinary skill in the art may optimize administration to humans based on animal data.

A dose of a dual receptor binding compound provided by the present disclosure and appropriate dosing intervals may be selected to maintain a sustained therapeutically effective concentration of the dual receptor binding compound provided by the present disclosure in the blood of a patient, and in certain embodiments, without exceeding a minimum adverse concentration.

A pharmaceutical composition comprising a dual receptor binding compound provided by the present disclosure may be administered, for example once per week, every 2 weeks, every 3 weeks, every 4 weeks, every 5 weeks, or every 6 weeks. Dosing may be provided alone or in combination with other drugs and may continue as long as required for effective treatment of the disease. Dosing may also be undertaken using continuous or semi-continuous administration over a period of time. Dosing includes administering a pharmaceutical composition to a mammal, such as a human, in a fed or fasted state.

A pharmaceutical composition may be administered in a single dosage form or in multiple dosage forms or as a continuous or an accumulated dose over a period of time. When multiple dosage forms are used the amount of a dual receptor binding compound provided by the present disclosure contained within each of the multiple dosage forms may be the same or different.

Suitable daily dosage ranges for administration can range, for example, from about 2 µg to about 200 mg of a dual receptor binding compound provided by the present disclosure per kilogram body weight.

Suitable daily dosage ranges for administration may range, for example, from about 1 µg to about 50 mg of a binding compound provided by the present disclosure per square meter ($m^2$) of body surface.

A dual receptor binding compound provided by the present disclosure may be administered to treat cancer in a patient in an amount, for example, from 0.001 mg/day to 100 mg/day, or in any other appropriate daily dose. A dose can be, for example, from 0.01 µg/kg body weight/week to 100 µg/kg body weight/week or any other suitable dose.

A pharmaceutical composition comprising a dual receptor binding compound provided by the present disclosure may be administered to treat cancer in a patient so as to provide a therapeutically effective concentration of a dual receptor binding compound provided by the present disclosure in the blood or plasma of the patient. A therapeutically effective concentration of a compound of a dual receptor binding compound provided by the present disclosure in the blood of a patient can be, for example, from 0.01 µg/L to 1,000 µg/L, from 0.1 µg/L to 500 µg/L, from 1 µg/L to 250 µg/L, or from about 10 µg/L to about 100 µg/L. A therapeutically effective concentration of a dual receptor binding compound provided by the present disclosure in the blood of a patient can be, for example, at least 0.01 µg/L, at least 0.1 µg/L, at least 1 µg/L, at least about 10 µg/L, or at least 100 µg/L. A therapeutically effective concentration of a dual receptor binding compound in the blood of a patient can be, for example, less than an amount that causes unacceptable adverse effects including adverse effects to homeostasis. A therapeutically effective concentration of a dual receptor binding compound in the blood of a patient can be an amount sufficient to restore and/or maintain homeostasis in the patient.

Pharmaceutical compositions comprising a dual receptor binding compound may be administered to treat a disease in a patient so as to provide a therapeutically effective concentration of the dual receptor binding compound in the blood of a patient for an extended period of time such as, for example, for at least 1 day, for at least 1 week, at least 2 weeks, at least 4 weeks, at least 5 week, or at least 6 weeks.

The amount of a dual receptor binding compound administered may vary during a treatment regimen.

Pharmaceutical compositions provided by the present disclosure may further comprise one or more pharmaceutically active compounds in addition to a dual receptor binding compound provided by the present disclosure. Such compounds may be provided, for example, to treat the cancer being treated with the dual receptor binding compound or to treat a disease, disorder, or condition other than the cancer being treated with the dual receptor binding compound, to treat a side-effect caused by administering the dual receptor binding compound, to augment the efficacy of the dual receptor binding compound, and/or to modulate the activity of the dual receptor binding compound.

A dual receptor binding compound provided by the present disclosure may be used in combination with at least one other therapeutic agent. A dual receptor binding compound may be administered to a patient together with another compound for treating cancer in the patient. The at least one other therapeutic agent can be a second, different dual receptor binding compound. A dual receptor binding compound and the at least one other therapeutic agent may act additively or, and in certain embodiments, synergistically with another dual receptor binding compound. The at least one additional therapeutic agent may be included in the same pharmaceutical composition or vehicle comprising the dual receptor binding compound or may be in a separate pharmaceutical composition or vehicle. Accordingly, methods provided by the present disclosure further include, in addition to administering a dual receptor binding compound, administering one or more therapeutic agents effective for treating cancer or a different disease, disorder or condition than cancer. Methods provided by the present disclosure include administration of a dual receptor binding compound and one or more other therapeutic agents provided that the combined administration does not inhibit the therapeutic efficacy of the dual receptor binding compound and/or does not produce adverse combination effects.

A pharmaceutical composition comprising a dual receptor binding compound may be administered concurrently with the administration of another therapeutic agent, which may be part of the same pharmaceutical composition as, or in a different pharmaceutical composition than that comprising a dual receptor binding compound. A dual receptor binding compound may be administered prior or subsequent to administration of another therapeutic agent. In certain combination therapies, the combination therapy may comprise alternating between administering a dual receptor binding compound and a composition comprising another therapeutic agent, e.g., to minimize adverse drug effects associated with a particular drug. When a dual receptor binding compound is administered concurrently with another therapeutic agent that potentially may produce an adverse drug effect including, for example, toxicity, the other therapeutic agent may be administered at a dose that falls below the threshold at which the adverse drug reaction is elicited.

A pharmaceutical composition comprising a dual receptor binding compound provided by the present disclosure may be administered with one or more substances, for example, to enhance, modulate and/or control release, bioavailability, therapeutic efficacy, therapeutic potency, and/or stability, of the dual receptor binding compound. For example, a pharmaceutical composition comprising a dual receptor binding compound can be co-administered with an active agent having pharmacological effects that enhance the therapeutic efficacy of the dual receptor binding compound.

A dual receptor binding compound, or a pharmaceutical composition thereof may be administered in conjunction with an agent known or believed to be effective in treating a disease such as cancer, an autoimmune disease or an inflammatory disease in a patient, such as the same disease being treated with the dual receptor binding compound.

A dual receptor binding compound, or a pharmaceutical composition thereof may be administered in conjunction with an agent known or believed to interfere with cell proliferation.

A dual receptor binding compound, or a pharmaceutical composition thereof may be administered in conjunction with an agent known or believed to interfere with cellular metabolism, to be an anti-metabolite, to interfere with RNA transcription, to interfere with RNA translation, to interfere with cellular protein synthesis, to interfere with synthesis of precursors for DNA synthesis and replication, to interfere with purine synthesis, to interfere with nucleoside synthesis, to interact with mTOR, to be an mTOR inhibitor, to interfere with cell cycle checkpoints.

A dual receptor binding compound or a pharmaceutical composition thereof may be administered in conjunction with a checkpoint inhibitor including a CTLA-4 inhibitor such as ipilimumab, a PD-1 inhibitor such as pembrolizumab and nivolumab, and/or a PD-LI inhibitor such as atezolizumab, avelumab, and durvalumab. A dual receptor binding compound or a pharmaceutical composition thereof may be administered in conjunction with an immunomodulator such as CD137/4-1BB, CD27, GIYR, and/or OC40.

A dual receptor binding compound or a pharmaceutical composition thereof may be administered in conjunction with an agent known or believed to be cytotoxic, to cause DNA damage, to cause cell cycle arrest, or to cause mitotic catastrophe.

A dual receptor binding compound or a pharmaceutical composition thereof may be administered in conjunction with an agent known or believed to modulate glutathione concentration, to modulate glutathione concentration within cells, to decrease glutathione concentration within cells, to reduce glutathione uptake into cells, to reduce glutathione synthesis, or to reduce glutathione synthesis within cells.

A dual receptor binding compound or a pharmaceutical composition thereof may be administered in conjunction with an agent known or believed to interfere with neovascularization, to reduce neovascularization, or to promote neovascularization.

A dual receptor binding compound or a pharmaceutical composition thereof may be administered in conjunction with an agent known or believed to interfere with hormone homeostasis, to interfere with hormone synthesis, to interfere with hormone receptor binding, or to interfere with hormone signal transduction.

A dual receptor binding compound or a pharmaceutical composition thereof may be administered in conjunction with an agent known or believed to interfere with growth factor homeostasis, to interfere with growth factor receptor expression, to interfere with growth factor binding to growth factor receptors, to interfere with growth factor receptor signal transduction, to interfere with the Hedgehog (Hh) signaling, to inhibit the Hedgehog pathway signaling, to inhibit ALK (anaplastic lymphoma kinase) pathway signaling, or to inhibit the non-homologous end joining (NHEJ) pathway.

A dual receptor binding compound or a pharmaceutical composition thereof may be administered in conjunction with one or more agents known or believed to be a VEGFR (vascular endothelial growth factor receptor) inhibitor, a RTK (receptor tyrosine kinase) inhibitor, a sodium channel current blocker, aFAK (focal adhesion kinase) inhibitor, a GLI (glioma-associated oncogene) inhibitor, a GLI1 inhibitor, a GLI2 inhibitor, a GLI3 inhibitor, a MAPK (mitogen-activated protein kinase) inhibitor, a MAPK/ERK pathway (also known as Ras-Raf-MEK-ERK pathways) inhibitor, a MEK1 inhibitor, a MEK2 inhibitor, a MEK5 inhibitor, a MEK5/ERK5 inhibitor, aRTA (renal tubular acidosis) inhibitor, a ALK (anaplastic lymphoma kinase) inhibitor, Aa LK kinase inhibitor, a nuclear translocation inhibitor, a PORCN (porcupine) inhibitor, a 5-ARI (5α-reductase inhibitor), topoisomerase inhibitor, a Ras (rat sarcoma) inhibitor, a K-ras inhibitor, a CERK (ceramide kinase) inhibitor, a PKB (protein kinase B, also known as AKT) inhibitor, a AKT1 inhibitor, EZH2 (enhancer of zeste homolog 2) inhibitor, a BET (bromodomain and extraterminal domain motif) inhibitor, a SYK (spleen tyrosine kinase) inhibitor, JAK (janus kinase) inhibitors, a SYK/JAK inhibitor, a IDO (indoleamine-pyrrole 2,3-dioxygenase) inhibitor, a IDO1 inhibitor, a RXR (retinoic X receptors) activating agent, a selective RXR activating agent, a p-glycoprotein inhibitor, a ERK inhibitor, a PI3K (phosphatidylinositol-4,5-bisphosphate 3-kinase) inhibitor, a BRD (bromodomain-containing protein) inhibitor, a BRD2 inhibitor, a BRD3 inhibitor, a BRD4 inhibitor, a BRDT (bromodomain testis-specific protein) inhibitor, a reverse transcriptase inhibitor, a NRT (nucleoside analog reverse-transcriptase) inhibitor, a PIM (proviral integrations of moloney virus) inhibitor, a EGFR (epidermal growth factor receptor) inhibitor, a photosensitizer, a radiosensitizer, a ROS (proto-oncogene, receptor tyrosine kinase) inhibitor, a ROS1 (proto-oncogene 1) inhibitor, a CK (casein kinase) inhibitor, a CK2 inhibitor, a Bcr-Abl (breakpoint cluster region—Abelson proto-oncogene) tyrosine-kinase inhibitor such as dasatinib, a microtubule stabilizing agent, a microtubule depolymerization/disassembly inhibitor, a DNA intercalator, an androgen receptor antagonist, a chemoprotective agents, a HDAC (histone deacetylase) inhibitor, a DPP (dipeptidyl peptidase) inhibitor, a DPP-4 inhibitor, BTK (Bruton's tyrosine kinase) inhibitor, a kinase inhibitor such as imatinib, a tyrosine kinase inhibitor such as nilotinib, a ARP (poly (ADP-ribose) polymerase) inhibitor, a CDK (cyclin-dependent kinase) inhibitor, a CDK4 inhibitor, a CDK6 inhibitor, a CDK4/6 inhibitor, a HIF1α (hypoxia-inducible factor 1-α) inhibitor, a DNA ligase inhibitor, a DNA ligase IV inhibitor, a NHEJ (non-homologous end joining) inhibitor, a DNA ligase IV, a NHEJ inhibitor and a RAF inhibitor, a TKI and a RAF inhibitor, a TKI and RAF inhibitor such as sorafenib, a PDT (photodynamic therapy) sensitizer, an ATR (ataxia telangiectasia- and Rad3-related protein kinase) inhibitor, or a combination of any of the foregoing.

A dual receptor binding compound or a pharmaceutical composition thereof may be administered in conjunction with one or more chemotherapeutic agents, such as, for example, a VEGFR inhibitor such as fruquintinib, motesanib/AMG-706, vatalanib; a RTK inhibitor such as ponatinib; a sodium channel blocker such as GS967; a FAK inhibitor such as TAE226; a GLI1 and GLI2 inhibitor such as GANT61, a MEK inhibitor such as binimetinib; a RTA inhibitor such as linifanib; an ALK inhibitor such as brigstinib; bromopyruvic acid; a DNA alkylating agent such as thiotepa; nuclear translocations factors such as JSH-23; a PORCn inhibitor such as Wnt-C59; a 5α-reductase inhibitor such as dutasteride; a topoisomerase inhibitor such as carubicin; a RAS inhibitor such as Kobe0065; a CerK inhibitor such as NVP-231; an AKT inhibitor such as uprosertib; a EZH2 inhibitor such as GSK-503; a BET bromodomain inhibitor such as OTX015; a MEK5/ERK5 inhibitor such as BIX02189; a Syl/JAK inhibitor such as cerdulatinib; an IDO1 inhibitor such as NLG919; a retinoic X receptor activating agent such as bexsrotene; a PGP inhibitor such as acotiamide or actotiamide HCl; an Erk inhibitor such SCH772984; a PI3K inhibitor such as gedatolisib; a JAK inhibitor such as ruxolitinib; an AKT inhibitor such as afuresertib or afuresertib HCl; an ALK1 inhibitor such as ceritinib; an HDAC inhibitor such as abexinostat; a DPP inhibitor such as oamarigliptin; an EGFR inhibitor such as gefittinib; an EZH2 inhibitor such as GSK126; a BTK inhibitor such as ibrutinib; a kinase inhibitor such as imatinin HCl; an IDO inhibitor such as INCB024360; a DNA crosslinker such as mitomycin C; a tyrosine kinase inhibitor such as nilotinib, a PARP inhibitor such as olaparib; a tubulin stabilization promoter such as paclitaxel; a CDK4/6 inhibitor such as palbociclib; a RTK inhibitor such as sunitinib; a PDT sensitizer such as tslsporfin; a p-glycoprotein inhibitor such as tariquidar; an ATR inhibitor such as VE-822; an HDAC inhibitor such as PCI-24781; a DPP inhibitor such as omarigliptin; an EGFR inhibitor such as gefinib; an EZH2 inhibitor such as GSK126; a BTK inhibitor such as irbrutinib; an IDO inhibitor such as INCB024360; or a combination of any of the foregoing.

For example, a dual receptor binding compound or a pharmaceutical composition thereof may be administered in conjunction with another chemotherapeutic agent, such as, for example, N-acetyl cysteine (NAC), adriamycin, alemtuzumab, amifostine, arsenic trioxide, ascorbic acid, bendamustine, bevacizumab, bortezomib, busulfan, buthionine sulfoxime, carfilzomib, carmustine, clofarabine, cyclophosphamide, cyclosporine, cytarabine, dasatinib, datinomycin, defibrotide, dexamethasone, docetaxel, doxorubicin, etoposide, filgrastim, floxuridine, fludarabine, gemcitabine, interferon alpha, ipilimumab, lenalidomide, leucovorin, melphalan, mycofenolate mofetil, paclitaxel, palifermin, panobinostat, pegfilrastim, prednisolone, prednisone, revlimid, rituximab, sirolimus, sodium 2-mercaptoethane sulfonate (MESNA), sodium thiosulfate, tacrolimus, temozolomide, thalidomide, thioguanine, thiotepa, topotecan, velcade, or a combination of any of the foregoing.

A dual receptor binding compound or a pharmaceutical compositions thereof can be used in combination therapy with other chemotherapeutic agents including one or more antimetabolites such as folic acid analogs; pyrimidine analogs such as fluorouracil, floxuridine, and cytosine arabinoside; purine analogs such as mercaptopurine, thiogunaine, and pentostatin; natural products such as vinblastine, vincristine, etoposide, tertiposide, dactinomycin, daunorubicin, doxorubicin, bleomycin, mithamycin, mitomycin C, L-asparaginase, and interferon alpha; platinum coordination complexes such as cis-platinum, and carboplatin; mitoxantrone; hydroxyurea; procarbazine; hormones and antagonists such as prednisone, hydroxyprogesterone caproate, medroxyprogesterone acetate, megestrol acetate, diethylstilbestrol, ethinyl estradiol, tamoxifen, testosterone propionate, fluoxymesterone, flutamide, and leuprolide, anti-angiogenesis agents or inhibitors such as angiostatin, retinoic acids, paclitaxel, estradiol derivatives, and thiazolopyrimidine derivatives; apoptosis prevention agents; triptolide; colchicine; luliconazole; and radiation therapy.

A dual receptor binding compound or a pharmaceutical composition thereof may be co-administered with a compound that inhibits DNA repair such as, for example, O6-benzylguanine (O6-BG).

A dual receptor binding compound or a pharmaceutical composition thereof may be administered in conjunction with one or more chemotherapeutic agents, such as, for example, abarelix, abiraterone, abiraterone acetate, n-acetyl cysteine, aclarubicin hydrochloride, adriamycin, adenine, afatinib, afatinib dimaleate, alemtuzumab, alendronate sodium, alitretinoin, allopurinol sodium, altretamine, amifostine, aminoglutethimide, aminolevulinic acid, amrubicin, amsacrine, anastrozole, angiostatin, apremilast, aprepitant, arsenic trioxide, ascorbic acid, 1-asparaginase, azacitidine, azathioprine sodium, bazedoxifene (serm), belinostat, bendamustine hcl, O6-benzylguanine, bevacizumab, bexarotene, bicalutamide, biricodar, bleomycin sulfate, bortezomib, bosutinib, brivudine, buserelin, busulfan, buthionine sulfoxime, cabazitaxel, cabozantinib, capecitabine, carboplatin, carboquone, carfilzomib, carmofur, carmustine, ceritinib, chlorambucil, cisplatin, cladribine, clodronate disodium, clofarabine, crizotinib, cyclophosphamide, cyclosporine, cytarabine, cytosine arabinoside, dabrafenib, dacarbazine, dactinomycin, dasatinib, datinomycin, daunorubicin, decitabine, defribrotide, degarelix acetate, dexamethasone, dexrazoxane hydrochloride, diaziquone, diethyl stilbestrol, docetaxel, doxifluridine, doxorubicin hydrochloride, doxorubicin free base, dromostanolone propionate, dutasteride, eltrombopag, enzalutamide, epirubicin hydrochloride, eribulin mesylate, erlotinib hydrochloride, estramustine phosphate sodium, ethinyl estradiol, etoposide phosphate, etoposide, everolimus, exemestane, fentanyl, filgrastim, fingolimod, floxuridine, fludarabine phosphate, fluorouracil, fluoxymesterone, flutamide, formestane, formylmelphalan, fosaprepitant, fotemustine, fulvestrant, gefitinib, gemcitabine hydrochloride, gemcitabine free base, glutathione, glyciphosphoramide, glyfosfin, goserelin acetate, granisetron hydrochloride, heptaplatin, hexyl 5-aminolevulinate, histrelin acetate, hydroxyprogesterone caproate, hydroxyurea, ibandronate sodium, ibrutinib, icotinib, idarubicin HCl, idelalisib, idoxuridine, ifosfamide, interferon alpha, imatinib mesylate, imiquimod, ingenol mebutate, ipilimumab, irinotecan hydrochloride, ixabepilone, lanreotide acetate, lapatinib free base, lapatinib ditosylate, lasofoxifene, lenalidomide, letrozole, leucovorin calcium, leuprolide acetate, levamisole hydrochloride, levoleucovorin calcium, iobenguane, lobaplatin, lomustine, maropitant, masoprocol, mechlorethamine hydrochloride, megestrol acetate, medroxyprogesterone acetate, melphalan hydrochloride, mercaptopurine, mercaptoethane sulfonate sodium, methotrexate, methoxsalen, methyl aminolevulinate, methylene blue, methylisoindigotin, mifamurtide, miltefosine, miriplatin, mithamycin, mitobronitol, mitomycin C, mitotane, mitoxantrone hydrochloride, mycophenolate mofetil, nabiximols, nafarelin, nandrolone, nedaplatin, nelarabine, netupitant, nilotinib, nilutamide, nimustine, nintedanib, nocodazole, octreotide, olaparib, omacetaxine mepesuccinate, ondansetron hydrochloride, oxaliplatin, paclitaxel, palbociclib, palifermin, palonosetron hydrochloride, pamidronate disodium, panobinostat, pasireotide, pazopanib hydrochloride, pegfilrastim, pemetrexed disodium, pentostatin, peplomycin, pipobroman, pirarubicin, plerixafor, plicamycin, pomalidomide, ponatinib, porfimer sodium, porfiromycin, pralatrexate, prednimustine, prednisolone, prednisone, procarbazine hydrochloride, quinagolide hydrochloride, raloxifene, raltitrexed, radotinib, ranimustine, retinoic acids, revlimide, rituxinab, romidepsin, ruxolitinib, ruxolitinib phosphate, semustine, sirolimus, sodium thiosulfate, sorafenib free base, sorafenib tosylate, streptozocin, sufentanil, sunitinib, tacrolimus, talaporfin sodium, tamibarotene, tamoxifen citrate, tapentadol, temoporfin, temozolomide, temsirolimus, teniposide, teriflunomide, tertiposide, testolactone, testosterone propionate, thalidomide, thioguanine, thiotepa, thymalfasin, toceranib phosphate, topotecan hydrochloride, toremifene citrate, trabectedin, trametinib, tretinoin, trilostane, triptorelin, tropisetron, uramustine, valrubicin, vandetanib, vedotin, vemurafenib, verteporfin, vinblastine, vincristine sulfate, vincristine free base, vindesine, vinorelbine tartrate, vorinostat, and zoledronic acid.

A dual receptor binding compound or a pharmaceutical composition thereof may be administered in conjunction with one or more chemotherapeutic agents such as, for example, abemaciclib, abiraterone acetate, ABVD, ABVE, ABVE-PC, AC, acalabrutinib, AC-T, ADE, ado-trastuzumab emtansine, afatinib dimaleate, aldesleukin, alectinib, alemtuzumab, alpelisib, amifostine, aminolevulinic acid hydrochloride, anastrozole, apalutamide, aprepitant, arsenic trioxide, asparaginase *Erwinia chrysanthemi*, atezolizumab, avelumab, axicabtagene ciloleucel, axitinib, azacitidine, BEACOPP, belinostat, bendamustine hydrochloride, BEP, bevacizumab, bexarotene, bicalutamide, binimetinib, bleomycin sulfate, blinatumomab, bortezomib, bosutinib, brentuximab vedotin, brigatinib, BuMel, busulfan, cabazitaxel, cabozantinib-s-malate, CAF, calaspargase pegol-mknl, capecitabine, caplacizumab-yhdp, CAPOX, carboplatin, carboplatin-taxol, carfilzomib, carmustine, carmustine implant, CEM, cemiplimab-rwlc, ceritinib, cetuximab, CEV, chlorambucil, chlorambucil-prednisone, CHOP, cisplatin, cladribine, clofarabine, CMF, cobimetinib, copanlisib hydrochloride, COPDAC, COPP, COPP-ABV, crizotinib, CVP, cyclophosphamide, cytarabine, cytarabine liposome, dabrafenib mesylate, dacarbazine, dacomitinib, dactinomycin, daratumumab, darbepoetin a, dasatinib, daunorubicin hydrochloride, daunorubicin hydrochloride and cytarabine liposome, decitabine, defibrotide sodium, degarelix, denileukin diftitox, denosumab, dexamethasone, dexrazoxane hydrochloride, dinutuximab, docetaxel, doxorubicin hydrochloride, doxorubicin hydrochloride liposome, durvalumab, duvelisib, elotuzumab, eltrombopag olamine, emapalumablzsg, enasidenib mesylate, encorafenib, enzalutamide, epirubicin hydrochloride, EPOCH, epoetin alfa, erdafitinib, eribulin mesylate, erlotinib hydrochloride, etoposide, etoposide phosphate, everolimus, exemestane, fec, filgrastim, fludarabine phosphate, fluorouracil injection, fluorouracil—topical, flutamide, folfiri, folfiri-bevacizumab, folfiri-cetuximab, folfirinox, folfox, fostamatinib disodium, FU-LV, fulvestrant, gefitinib, gemcitabine hydrochloride, gemcitabine-cisplatin, gemcitabine-oxaliplatin, gemtuzumab ozogamicin, gilteritinib fumarate, glasdegib maleate, glucarpidase, goserelin acetate, granisetron, HPV bivalent vaccine, HPV bivalent vaccine, recombinant HPV nonavalent vaccine, HPV nonavalent vaccine, recombinant, HPV quadrivalent vaccine, HPV uadrivalent vaccine recombinant, hydroxyurea, hyper-CVAD, ibritumomab tiuxetan, ibrutinib, ICE, idarubicin hydrochloride, idelalisib, ifosfamide, imatinib mesylate, imiquimod, inotuzumab ozogamicin, interferon α-2b recombinant, iobenguane $^{131}$I, ipilimumab, irinotecan hydrochloride, irinotecan hydrochloride liposome, ivosidenib, ixabepilone, ixazomib citrate, JEB, lanreotide acetate, lapatinib ditosylate, larotrectinib sulfate, lenalidomide, lenvatinib mesylate, letrozole, leucovorin calcium, leuprolide acetate, lomustine, lorlatinib, lutetium Lu 177-dotatate, mechlorethamine hydrochloride, megestrol acetate, melphalan, melphalan hydrochloride, mercaptopurine, mesna, methotrexate, methylnaltrexone bromide, midostaurin, mitomycin c, mitoxantrone hydrochloride, mogamulizumab-kpkc, moxetumomab pasudotox-tdfk, MVAC, necitumumab, nelarabine, neratinib maleate, netupitant and palonosetron hydrochloride, nilotinib, nilutamide, niraparib tosylate monohydrate, nivolumab, obinutuzumab, OEPA, ofatumumab, OFF, olaparib, olaratumab, omacetaxine mepesuccinate, ondansetron hydrochloride, OPPA, osimertinib mesylate, oxaliplatin, paclitaxel, paclitaxel albumin-stabilized nanoparticle formulation, PAD, palbociclib, palifermin, palonosetron hydrochloride, palonosetron hydrochloride and netupitant, pamidronate disodium, panitumumab, panobinostat, pazopanib hydrochloride, PCV, PEB, pegaspargase, pegfilgrastim, peginterferon α-2b, pembrolizumab, pemetrexed disodium, pertuzumab, plerixafor, polatuzumab vedotin-piiq, pomalidomide, ponatinib hydrochloride, pralatrexate, prednisone, procarbazine hydrochloride, propranolol hydrochloride, radium 223 dichloride, raloxifene hydrochloride, ramucirumab, rasburicase, ravulizumab-cwvz, R-CHOP, R-CVP, recombinant HPV bivalent vaccine, recombinant HPV nonavalent vaccine, recombinant HPV quadrivalent vaccine, recombinant interferon α-2b, regorafenib, R-EPOCH, ribociclib, R-ICE, rituximab, rituximab and hyaluronidase human, rolapitant hydrochloride, romidepsin, romiplostim, rucaparib camsylate, ruxolitinib phosphate, siltuximab, sipuleucel-t, sonidegib, sorafenib tosylate, STANFORD V, sunitinib malate, TAC, tagraxofusp-erzs, talazoparib tosylate, talc, talimogene laherparepvec, tamoxifen citrate, temozolomide, temsirolimus, thalidomide, thioguanine, thiotepa, tisagenlecleucel, tocilizumab, topotecan hydrochloride, toremifene, TPF, trabectedin, trametinib, trastuzumab, trastuzumab and hyaluronidase-oysk, trifluridine and tipiracil hydrochloride, uridine triacetate, VAC, Valrubicin, VAMP, vandetanib, VeIP, vemurafenib, venetoclax, vinblastine sulfate, vincristine sulfate liposome, vinorelbine tartrate, vip, vismodegib, vorinostat, XELIRI, XELOX, Ziv-aflibercept, zoledronic acid, and combinations of any of the foregoing.

The efficacy of administering a dual receptor binding compound or a pharmaceutical composition thereof for treating cancer may be assessed using in vitro and animal studies and in clinical trials.

The suitability of a dual receptor binding compound or a pharmaceutical composition thereof in treating cancer may be determined by methods described in the art.

A dual receptor binding compound or a pharmaceutical composition thereof can be useful in treating inflammatory diseases.

A dual receptor binding compound or a pharmaceutical composition thereof may be administered to a patient in need of such treatment to treat an inflammatory disease.

Examples of inflammatory diseases include allergy, Alzheimer's disease, anemia, ankylosing spondylitis, arthritis, atherosclerosis, asthma, autism, arthritis, carpal tunnel syndrome, celiac disease, colitis, Crohn's disease, congestive heart failure, dermatitis, diabetes, diverticulitis, eczema, fibromyalgia, fibrosis, gall bladder disease gastroesophageal reflux disease, Hashimoto's thyroiditis, heart attack, hepatitis, irritable bowel syndrome, kidney failure, lupus, multiple sclerosis, nephritis, neuropathy, pancreatitis, Parkinson's disease, psoriasis, polymyalgia rheumatica, rheumatoid arthritis, scleroderma, stroke, surgical complications, and ulcerative colitis.

A dual receptor binding compound or a pharmaceutical composition thereof can be useful in treating autoimmune diseases. Autoimmune diseases can be defined as human diseases in which the immune system attacks its own proteins, cells, and/or tissues. A comprehensive listing and review of autoimmune diseases can be found, for example, in *The Autoimmune Diseases*, Rose and Mackay, 2014, Academic Press.

A dual receptor binding compound or a pharmaceutical composition thereof may be administered to a patient in need of such treatment to treat an autoimmune disease.

Examples of autoimmune diseases include Addison's disease, agammaglobulinemia, alopecia areata, amyloidosis, ankylosing spondylitis, anti-GBM/anti-TBN nephritis, antiphospholipid syndrome, autoimmune angioedema, autoimmune dysautonomia, autoimmune encephalomyelitis, autoimmune hepatitis, autoimmune inner ear disease, autoimmune myocarditis, autoimmune pancreatitis, autoimmune retinopathy, autoimmune urticaria, axonal and neuronal neuropathy, Balo's disease, Bechet's disease, benign mucosal pemphigoid, bullous pemphigoid, Castleman disease, celiac disease, Chagas disease, chronic inflammatory demyelinating polyneuropathy, chronic recurrent multifocal osteomyelitis, Churg-Strauss, cicatricial pemphigoid, Cogan's syndrome, cold agglutinin disease, congenital heart block, Coxsackie myocarditis, CREST syndrome, Crohn's disease, dermatitis herpetiformis, dermatomyositis, Devic's disease, discoid lupus, Dressler's syndrome, endometriosis, eosinophilic esophagitis, eosinophilic fasciitis, erythema nodosum, essential mixed cryoglobulinemia, Evans syndrome, fibromyalgia, fibrosing alveolitis, giant cell arteritis, giant cell myocarditis, glomerulonephritis, Goodpasture's syndrome, granulomatosis with polyangiitis, Graves' disease, Guillain-Barre syndrome, Hashimoto's thyroiditis, hemolytic anemia, Henoch-Schonlein purpura, herpes gestationis or pemphigoid gestationis, hypogammaglobulinemia, IgA nephropathy, IgG4-related sclerosing disease, immune thrombocytopenic purpura, inclusion body myositis, interstitial cystitis, juvenile arthritis, juvenile diabetes, juvenile myositis, Kawasaki disease, Lambert-Eaton syndrome, leukocytoclastic vasculitis, lichen planus, lichen sclerosis, ligneous conjunctivitis, linear IgA disease, lupus, Lyme disease chronic, Meniere's diseases, microscopic polyangiitis, mixed connective tissue disease, Mooren's ulcer, Mucha-Habermann disease, multiple sclerosis, myasthenia gravis, myositis, narcolepsy, neuromyelitis, optica, neutropenia, ocular cicatricial pemphigoid, optic neuritis, palindromic rheumatism, PANDAS, paraneoplastic cerebellar degeneration, paroxysmal nocturnal hemoglobinuria, Parry Romberg syndrome, pars planitis, Parsonage-Turner syndrome, pemphigus, peripheral neuropathy, perivenous encephalomyelitis, pernicious anemia, POEMS syndrome, polyarteritis nodosa, polyglandular syndromes, polymyalgia rheumatica, polymyositis, postmyocardial infarction syndrome, postpericardiotomy syndrome, primary biliary cirrhosis, primary sclerosing cholangitis, progesterone dermatitis, psoriasis, psoriatic arthritis, pure red cell aplasia, pyoderma gangrenosum, Raynaud's phenomenon, reactive arthritis, reflex sympathetic dystrophy, relapsing polychondritis, restless legs syndrome, retroperitoneal fibrosis, rheumatic fever, rheumatoid arthritis, sarcoidosis, Schmidt syndrome, scleritis, scleroderma, Sjogren's syndrome, sperm and testicular autoimmunity, stiff person syndrome, subacute bacterial endocarditis, Susac's syndrome, sympathetic *Ophthalmia*, Takayasu's arteritis, temporal arteritis, thrombocytopenic purpura, Tolosa-Hunt syndrome, transverse myelitis, type 1 diabetes, ulcerative colitis, undifferentiated connective tissue disease, uveitis, vasculitis, vitiligo, and Wegener's granulomatosis.

A dual receptor binding compound or a pharmaceutical composition thereof can be used to treat autoimmune disorders such as, for example, lupus, graft-versus-host disease, hepatitis C-induced vasculitis, Type I diabetes, multiple sclerosis, spontaneous loss of pregnancy, atopic diseases, and inflammatory bowel diseases.

A dual receptor binding compound can be administered with one or more additional therapeutic agents for treating an autoimmune disease. A dual receptor binding compound or a pharmaceutical composition thereof may be administered in conjunction with one or more immunosuppressants including, for example, corticosteroids such as prednisone, budesonide, and prednisolone; Janus kinase inhibitors such as tofacitinib; calcineurin inhibitors such as cyclosporine and tacrolimus; mTOR inhibitors such as sirolimus and everolimus; IMDH inhibitors such as azathioprine, leflunomide, and mycophenolate; biologics such as abatacept adalimumab, anakinra, certolizumab, etanercept, golimumab, infliximab, ixekizumab, natalizumab, rituximab, secukinumab, tocilizumab, ustekinumab, and vedolizumab; and monoclonal antibodies such as basiliximab and daclizumab.

A dual receptor binding compound or a pharmaceutical composition thereof may be administered to a patient to treat a disease associated with the activation, proliferation, metabolism, and/or differentiation of T-cells.

A dual receptor binding compound or a pharmaceutical composition thereof may be administered to a patient to treat an organ transplant.

A dual receptor binding compound or a pharmaceutical composition thereof may be administered in conjunction with an agent known or believed to interfere with proliferation, to interfere with mitosis, to interfere with DNA replication, or to interfere with DNA repair.

A dual receptor binding compound or a pharmaceutical composition thereof may be administered to a patient to treat an immune deficiency disease.

Example of primary immune deficiency disease include autoimmune lymphoproliferative syndrome, autoimmune polyglandular syndrome type 1, BENTA disease, caspase eight deficiency state, CARD9 deficiency, chronic granulomatous disease, common variable immunodeficiency, congenital neutropenia syndromes, CTLA4 deficiency, DOCK8 deficiency, GATA2 deficiency, glycosylation disorders, hyper-immunoglobulin E syndromes, hyper-immunoglobulin M syndromes, interferon γ, interleukin 12 and interleukin 23 deficiency, leukocyte adhesion deficiency, LRBA deficiency, PI2 kinase disease, PLCG2-associated antibody deficiency and immune dysregulation, severe combined immunodeficiency, STAT3 dominant-negative disease, STAT3 gain-of-function disease, warts, hypogammaglobulinemia, infections, and myelokathexis syndrome, Wiskott-Aldrich syndrome, X-linked agammaglobulinemia, X-linked lymphoproliferative disease, and XMEN disease.

Secondary immune deficiency disease occurs when the immune system is compromised to an environmental factor such as infection, chemotherapy, severe burns, or malnutrition. Example of secondary immune deficiency diseases include newborn immunodeficiencies such as immature lymphoid organs, absent memory immunity, low maternal IgG levels, decreased neutrophil storage pool, decreased neutrophil function, and decreased natural killer cell activity; advanced age related immunodeficiencies such as decreased antigen-specific cellular immunity, T-cell oligoconality, and restricted B-cell repertoire; malnutrition related immunodeficiencies such as decreased cellular immune response and weekend mucosal barriers; diabetes mellitus related immunodeficiencies such as decreased mitogen-induced lymphoproliferation, defective phagocytosis, and decreased chemotaxis; chronic uremia related immunodeficiencies such as decreased cellular immune response, decreased generation of memory antibody responses, and decreased chemotaxis; genetic syndromes such as defective phagocytosis, defective chemotaxis, and variable defects of antigen-specific immune responses; and anti-inflammatory, immunomodulatory, and immuno-suppressive drug therapy related immune deficiencies such as lymphopenia, decreased cellular immune response and anergy, decreased proinflammatory cytokines, decreased phagocytosis, decreased chemotaxis, neutropenia, and weakened mucosal barriers; environmental conditions such as increased lymphocyte apoptosis, increased secretion of tolerogenic cytokines, cytopenia, decreased cellular immunity and anergy, and stress-induced nonspecific immune activation; and infectious diseases such as T-cell lymphopenia, decreased cellular immune response and anergy, and defective antigen-specific antibody responses.

A dual receptor binding compound or a pharmaceutical composition thereof may be administered to a patient to increase the immune response in immuno-compromised patients.

A dual receptor binding compound or a pharmaceutical composition thereof may be administered to a patient to increase the immune response in elderly patients.

A dual receptor binding compound or a pharmaceutical composition thereof may be administered to a patient to treat an infectious disease.

Examples of infectious diseases include *Acinetobacter* infections, actinomycosis, African sleeping sickness (African trypanosomiasis), AIDS (acquired immunodeficiency syndrome), amoebiasis, anaplasmosis, angiostrongyliasis, anisakiasis, anthrax, *Arcanobacterium haemolyticum* infection, Argentine hemorrhagic fever, ascariasis, aspergillosis, astrovirus infection, babesiosis, *Bacillus cereus* infection, bacterial meningitis, bacterial pneumonia, bacterial vaginosis, *Bacteroides* infection, balantidiasis, bartonellosis, *Baylisascaris* infection, Bejel, syphilis, yaws, BK virus infection, black *piedra*, blastocystosis, blastomycosis, Bolivian hemorrhagic fever, botulism (and Infant botulism), Brazilian hemorrhagic fever, brucellosis, bubonic plague, *Burkholderia* infection, buruli ulcer, calicivirus infection (Norovirus and Sapovirus), campylobacteriosis, candidiasis (Moniliasis; Thrush), capillariasis, carrion's disease, cat-scratch disease, cellulitis, Chagas disease (American trypanosomiasis), chancroid, chickenpox, chikungunya, chlamydia, *Chlamydophila pneumoniae* infection (Taiwan acute respiratory agent or TWAR), cholera, chromoblastomycosis, *Chytridiomycosis*, clonorchiasis, *Clostridium difficile* colitis, coccidioidomycosis, Colorado tick fever (CTF), common cold (acute viral rhinopharyngitis; Acute coryza, Coronavirus disease 2019 (COVID-19), Creutzfeldt-Jakob disease (CJD), Crimean-Congo hemorrhagic fever (CCHF), cryptococcosis, cryptosporidiosis, cutaneous larva migrans (CLM), cyclosporiasis, cysticercosis, cytomegalovirus infection, Dengue fever, desmodesmus infection, dientamoebiasis, diphtheria, diphyllobothriasis, dracunculiasis, Ebola hemorrhagic fever, echinococcosis, Ehrlichiosis, enterobiasis (pinworm infection), *Enterococcus* infection, enterovirus infection, epidemic typhus, Epstein-Barr virus infectious mononucleosis (Mono), erythema infectiosum (Fifth disease), fxanthem subitum (Sixth disease), fasciolosis, fasciolopsiasis, fatal familial insomnia (FFI), filariasis, food poisoning by *Clostridium perfringens*, free-living amebic infection, *Fusobacterium* infection, gas gangrene (Clostridial myonecrosis), geotrichosis, Gerstmann-Sträussler-Scheinker syndrome (GSS), giardiasis, glanders, gnathostomiasis, gonorrhea, granuloma inguinale (Donovanosis), Group A streptococcal infection, Group B streptococcal infection, *Haemophilus influenzae* infection, hand, foot and mouth disease (HFMD), Hantavirus Pulmonary Syndrome (HPS), Heartland virus disease, *Helicobacter pylori* infection, hemolytic-uremic syndrome (HUS), hemorrhagic fever with renal syndrome (HFRS), Hendra virus infection, Hepatitis A, Hepatitis B, Hepatitis C, Hepatitis D, Hepatitis E, Herpes simplex, histoplasmosis, hookworm infection, human bocavirus infection, human ewingii ehrlichiosis, human granulocytic anaplasmosis (HGA), human metapneumovirus infection, human monocytic ehrlichiosis, human papillomavirus (HPV) infection, human parainfluenza virus infection, hymenolepiasis, influenza (flu), isosporiasis, Kawasaki disease, keratitis, Kingella kingae infection, Kuru, Lassa fever, Legionellosis (Legionnaires' disease), leishmaniasis, leprosy, leptospirosis, listeriosis, Lyme disease (Lyme borreliosis), lymphatic filariasis (elephantiasis), lymphocytic choriomeningitis, malaria, Marburg hemorrhagic fever (MHF), measles, melioidosis (Whitmore's disease), meningitis, meningococcal disease, metagonimiasis, microsporidiosis, Middle East respiratory syndrome (MERS), molluscum contagiosum (MC), monkeypox, mumps, murine typhus (Endemic typhus), mycetoma, *Mycoplasma genitalium* infection, *Mycoplasma* pneumonia, myiasis, neonatal conjunctivitis (*Ophthalmia neonatorum*), Nipah virus infection, nocardiosis, Norovirus (children and babies), onchocerciasis (River blindness), opisthorchiasis, paracoccidioidomycosis (South American blastomycosis), paragonimiasis, pasteurellosis, pediculosis capitis (Head lice), pediculosis corporis (Body lice), pediculosis pubis (pubic lice, crab lice), pelvic inflammatory disease (PID), pertussis (whooping cough), plague, pneumococcal infection, *Pneumocystis* pneumonia (PCP), pneumonia, poliomyelitis, Pontiac fever, *Prevotella* infection, primary amoebic meningoencephalitis (PAM), progressive multifocal leukoencephalopathy, psittacosis, Q fever, rabies, relapsing fever, respiratory syncytial virus infection, rhinosporidiosis, rhinovirus infection, rickettsial infection, rickettsialpox, Rift Valley fever (RVF), Rocky Mountain spotted fever (RMSF), rotavirus infection, rubella, salmonellosis, SARS (severe acute respiratory syndrome), scabies, scarlet fever, schistosomiasis, sepsis, shigellosis (bacillary dysentery), shingles (Herpes zoster), smallpox (variola), sporotrichosis, staphylococcal food poisoning, staphylococcal infection, strongyloidiasis, subacute sclerosing panencephalitis, taeniasis, tetanus (lockjaw), *Tinea barbae* (barber's itch), *Tinea capitis* (ringworm of the scalp), *Tinea corporis* (ringworm of the body), *Tinea cruris* (Jock itch), *Tinea manum* (ringworm of the hand), *Tinea nigra, Tinea pedis* (athlete's foot), *Tinea unguium* (onychomycosis), *Tinea versicolor* (*Pityriasis versicolor*), toxocariasis (ocular larva migrans (OLM)), toxocariasis (visceral larva migrans (VLM)), toxoplasmosis, trachoma, trichinosis, trichomoniasis, trichuriasis (whipworm infection), tuberculosis, tularemia, typhoid fever, typhus fever, *Ureaplasma urealyticum* infection, valley fever, Venezuelan equine encephalitis, Venezuelan hemorrhagic fever, *Vibrio parahaemolyticus* enteritis, *Vibrio vulnificus* infection, viral pneumonia, West Nile fever, white *piedra* (*Tinea blanca*), yellow fever, *Yersinia pseudotuberculosis* infection, yersiniosis, zeaspora, Zika fever, and zygomycosis.

A dual receptor binding compound provided by the present disclosure can be used, either alone or in combination, to treat diseases including acute myeloid leukemia, B-cell lymphoma, chronic myelogenous leukemia, depression, gingival recession, hepatitis C, HIV infections, human papillomavirus, idiopathic CD4 lymphopenia, immunodeficiency secondary to organ transplantation, lipodystrophy, Kaposi sarcoma lymphoma, lymphopenia, mantle cell lymphoma, multiple sclerosis, myelodysplastic syndrome, non-Hodgkin lymphoma, recurrent adult diffuse large cell lymphoma, recurrent follicular lymphoma, rheumatoid arthritis, sepsis, and Type 2 diabetes.

A dual receptor binding compound provided by the present disclosure can be used to treat cancers such as metastatic breast cancer, breast cancer, colon cancer, bladder cancer, metastatic prostate cancer, stage IV prostate cancer, castration-resistant prostate carcinoma, neuroblastoma, melanoma, kidney cancer, myeloproliferative neoplasm, sarcoma, and neurodermal tumors.

A dual receptor binding compound provided by the present disclosure can be used in combination with temozolomide to great glioblastoma, with atezolizumab to treat skin cancers such as MCC, C5CC and melanoma, with pembrolizumab to treat triple negative breast cancer, and in combination with CAR-T therapy to treat pediatric acute lymphoblastic leukemia.

Pharmaceutical compositions comprising a dual receptor binding compound be administered concurrently with the administration of another therapeutic agent, which may be part of the same pharmaceutical composition as, or in a different pharmaceutical composition than that comprising a dual receptor binding compound. A dual receptor binding compound may be administered prior or subsequent to administration of another therapeutic agent. In combination therapy, the combination therapy may comprise alternating between administering a dual receptor binding compound and a composition comprising another therapeutic agent, e.g., to minimize adverse drug effects associated with a particular drug. When a dual receptor binding compound is administered concurrently with another therapeutic agent that potentially may produce an adverse drug effect including, for example, toxicity, the other therapeutic agent may be administered at a dose that falls below the threshold at which the adverse drug reaction is elicited.

Pharmaceutical compositions comprising a dual receptor binding compound may be administered with one or more substances to enhance, modulate and/or control release, bioavailability, therapeutic efficacy, therapeutic potency, stability, of a dual receptor binding compound. For example, to enhance the therapeutic efficacy of a dual receptor binding compound, metabolite thereof, or a pharmaceutical composition of any of the foregoing may be co-administered with one or more active agents to increase the absorption or diffusion of the dual receptor binding compound from the gastrointestinal tract to the systemic circulation, or to inhibit degradation of the dual receptor binding compound in the blood of a subject. A pharmaceutical composition comprising a dual receptor binding compound may be co-administered with an active agent having pharmacological effects that enhance the therapeutic efficacy of the dual receptor binding compound.

A dual receptor binding compound, or a pharmaceutical composition comprising any of the foregoing may be administered in conjunction with an agent known or believed to be effective in treating an inflammatory disease or an autoimmune disease in a patient.

A dual receptor binding compound, or a pharmaceutical composition comprising any of the foregoing may be administered in conjunction with an agent known or believed to interfere with proliferation. A dual receptor binding compound, or a pharmaceutical composition comprising any of the foregoing may be administered in conjunction with an agent known or believed to interfere with mitosis. A dual receptor binding compound, or a pharmaceutical composition comprising any of the foregoing may be administered in conjunction with an agent known or believed to interfere with DNA replication. A dual receptor binding compound, or a pharmaceutical composition comprising a dual receptor binding compound may be administered in conjunction with an agent known or believed to interfere with DNA repair.

A dual receptor binding compound or a pharmaceutical composition thereof may be administered to a patient together with another compound for treating an inflammatory disease or an autoimmune disease in the patient. The at least one other therapeutic agent may be a different dual receptor binding compound provided by the present disclosure. A dual receptor binding compound and the at least one other therapeutic agent may act additively or synergistically. The at least one additional therapeutic agent may be included in the same pharmaceutical composition or vehicle comprising the dual receptor binding compound or may be in a separate pharmaceutical composition or vehicle. Accordingly, methods provided by the present disclosure further include, in addition to administering a dual receptor binding compound, administering one or more therapeutic agents effective for treating an inflammatory disease or an autoimmune disease or a different disease, disorder or condition than an inflammatory disease or an autoimmune disease. Methods provided by the present disclosure include administering a dual receptor binding compound and one or more other therapeutic agents provided that the combined administration does not inhibit the therapeutic efficacy of the dual receptor binding compound and/or does not produce adverse combination effects.

A dual receptor binding compound provided by the present disclosure can be useful in vitro as tools for understanding the biological role of IL-2R and IL-7, including the evaluation of the factors thought to influence, and be influenced by, the production of IL-2R and IL-7 and the receptor binding process. A dual receptor binding compound can also useful in the development of other compounds that bind to and activate IL-2R and IL-7R, because the compounds provide useful information concerning the relationship between structure and activity that should facilitate such development.

A dual receptor binding compound can also be useful as a competitive binder in assays to screen for new IL-2R and IL-7R agonists and antagonists. In such assays, dual receptor binding compounds can be used without modification or can be modified in a variety of ways; for example, by labeling, such as covalently or non-covalently joining a moiety which directly or indirectly provides a detectable signal. In any of these assays, a dual receptor binding compound can be labeled either directly or indirectly. Possibilities for direct labeling include label groups such as: radiolabels such as $^{125}$I, enzymes such as peroxidase and alkaline phosphatase, and fluorescent labels capable of monitoring the change in fluorescence intensity, wavelength shift, or fluorescence polarization. Possibilities for indirect labeling include biotinylation of one constituent followed by binding to avidin coupled to one of the above label groups. The compounds may also include spacers or linkers in cases where the compounds are to be attached to a solid support.

Based on their ability to bind to IL-2R and to IL-7R, dual receptor binding compounds provided by the present disclosure can be used as reagents for detecting IL-2R and IL-7R, for example, on living cells, fixed cells, in biological fluids, in tissue homogenates, in purified, and natural biological materials. For example, by labeling such peptides, one can identify cells expressing the IL-2Rβ, IL-7Rα and Rγc subunits. In addition, based on their ability to bind to IL-2R and to IL-7R, the dual receptor binding compounds of the present disclosure can be used, for example, in in situ staining, FACS (fluorescence-activated cell sorting), Western Blotting, and ELISA. In addition, based on their ability to bind to IL-2R and to IL-7R, dual receptor binding compounds provided by the present disclosure can be used in receptor purification, or in purifying cells expressing IL-2R and IL-7R on the cell surface (or inside permeabilized cells).

A dual receptor binding compound provided by the present disclosure can also be utilized as commercial reagents for various medical research and diagnostic uses. Such uses include, for example, (1) use as a calibration standard for quantitating the activities of candidate IL-2R and IL-7R agonists in a variety of functional assays; (2) use to maintain the proliferation and growth of IL-2 and/or IL-7-dependent cell lines; (3) use in structural analysis of IL-2R and IL-7R through co-crystallization; (4) use to investigate the mechanism of Il-2R and IL-7 signal transduction/receptor activation; and (5) other research and diagnostic applications wherein IL-2R and IL-7R is implicated.

A dual receptor binding compound can include diagnostic reagents. As a diagnostic agent, a dual receptor binding compound can be used to detect and/or to measure cells expressing IL-2R and IL-7R. The compounds can be used to determine the level of IL-2R and IL-7R expression of a cell, or population of cells, or of a tissue. The compounds can be used to assess the binding affinity to IL-2R and IL-7R in a cell or population of cells. The compounds may be used to determine the particular type of cell, for example, based on IL-2R and IL-7R expression levels.

The compounds can be useful for in vitro and in vivo diagnostics.

A diagnostic dual receptor binding compound can comprise a detectable marker. The detectable marker can be cleavable or non-cleavable.

A detectable marker can comprise, for example, a radiolabel, a fluorescent label, an enzymatic label.

A diagnostic dual receptor binding compound can be used to measure cells expressing the IL-2Rβ and/or IL-7Rα subunit and/or the level of expression of cells expressing the IL-2Rβ and/or IL-7Rα subunit in a biological sample such as a sample of blood of a patient. Measurements can be made, for example, using flow cytometry. The number of cells expressing the IL-2Rβ and/or IL-7Rα subunit and/or the expression level of the IL-2Rβ and/or IL-7Rα subunit, when correlated with a disease in a patient or a pharmacologically significant parameter of the disease in a patient can be used to inform treatment of the disease. For example, if a level of expression of the IL-2Rβ and/or IL-7Rα subunit is above or below a therapeutically meaningful threshold for a particular disease, a dual receptor binding provided by the present disclosure can be administered to the patient to treat the disease.

A dual receptor binding compound can be attached to a solid support. Based on the ability of the compounds to bind to IL-2R and to IL-7R, the compounds can be used as reagents for detecting IL-2R and IL-7R, for example, on living cells, fixed cells, in biological fluids, in tissue homogenates, in purified, and natural in biological materials. In addition, based on their ability to bind to IL-2R and to IL-7R, the dual receptor binding compounds can be used, for example, in in situ staining, FACS (fluorescence-activated cell sorting), Western Blotting, and ELISA. In addition, dual receptor binding compounds provided by the present disclosure can be used in receptor purification, or to purify cells expressing Il-2R and/or IL-7R on the cell surface.

Aspects of the present invention include nucleic acids encoding for IL-2Rβ ligands, IL-7Rα ligands, Rγc ligands, IL-2Rβγc ligands, IL-7Rαγc ligands, tandem IL-2Rβγc ligands, tandem IL-7Rαγc ligands, and dual receptor binding compounds such as dual receptor binding ligands and dual receptor binding constructs provided by the present disclosure.

Nucleic acids/isolated polynucleotides encoding the dual receptor binding compounds provided by the present disclosure can be incorporated into expression vectors depending in part on the host cells used to produce the dual receptor binding compounds provided by the present disclosure. Generally, the nucleic acids can be operably linked to any number of regulatory elements such as, for example, promoters, origin of replication, selectable markers, ribosomal binding sites, and/or inducers. The expression vectors can be extra-chromosomal or integrating vectors.

The nucleic acids and/or expression vectors can be transformed into any number of different types of host cells including mammalian, bacterial, yeast, insect and/or fungal cells, with mammalian cells such as CHO cells.

For example, a nucleic acid encoding an IL-7Rαγc ligand can comprise a first nucleic acid sequence encoding an IL-7Rα ligand; a second nucleic acid sequence encoding a peptidyl ligand linker; and a third nucleic acid sequence encoding an Rγc ligand. For example, a nucleic acid encoding a linear dual receptor binding ligand can comprise a first nucleic acid sequence encoding for an IL-2Rβ ligand, a second nucleic acid sequence encoding for a first peptidyl ligand linker, a third nucleic acid sequence encoding an IL-7Rα ligand; a fourth nucleic acid sequence encoding a second peptidyl ligand linker; and a fifth nucleic acid sequence encoding an Rγc ligand.

A nucleic acid encoding a dual receptor binding fusion protein can comprise, for example, a first nucleic acid sequence encoding an IL-2Rβγc ligand, a second nucleic acid sequence encoding an IL-7Rαγc ligand; and a third nucleic acid sequence encoding a fusion partner. A nucleic acid encoding a dual receptor binding fusion protein can comprise a nucleic acid encoding dual receptor binding ligand and the fusion partner. A nucleic acid encoding a dual receptor binding fusion protein can further comprise a nucleic acid sequence encoding a construct linker and a nucleic acid encoding a dual receptor binding fusion protein can comprise a nucleic acid encoding a dual receptor binding ligand, the fusion partner, and the construct linker.

The fusion partner can comprise, for example, HSA, an Fc-fragment, an IgG, an antibody directed to a cell-specific antigen, and an antibody directed to a cell-specific receptor.

A nucleic acid encoding a dual receptor binding fusion protein can further comprise a nucleic acid encoding a peptidyl linker, where the peptidyl linker is configured to bind a ligand to the fusion partner.

A nucleic acid provided by the present disclosure can encode a fusion protein comprising a dual receptor binding ligand, and a linker binding the C-terminus of the dual receptor binding ligand to HSA.

A nucleic acid provided by the present disclosure can encode a fusion protein comprising a dimeric Fc-Fragment of IgG1, IgG2, or IgG4, a ligand, and a linker binding the N-terminus of the a receptor binding to the C-terminus of one CH3 domain of the dimeric Fc-fragment.

A nucleic acid provided by the present disclosure can encode a fusion protein comprising a dimeric Fc-Fragment of IgG1, IgG2, or IgG4, two receptor binding ligands, and a linker binding the N-terminus of each of the two IL-7Rαγc ligands to the C-terminus of each CH3 domain of the dimeric Fc-fragment.

A nucleic acid provided by the present disclosure can encode a fusion protein comprising a heavy chain of an immunoglobulin molecule such as IgG1, IgG2, or IgG4, a ligand, and an Fc linker bonding the N-terminus of a receptor binding ligand to the C-terminus of the Fc region.

A nucleic acid provided by the present disclosure can comprise a nucleic acid encoding for a dual receptor binding compound provided by the present disclosure and an RNA and/or DNA vaccine.

A nucleic acid provided by the present disclosure can comprise a nucleic acid encoding for a dual receptor binding vaccine construct. The vaccine can comprise, for example, a cancer vaccine or a viral vaccine.

A nucleic acid provided by the present disclosure can comprise a nucleic acid encoding for a dual receptor binding construct comprising a viral surface antigen.

A nucleic acid provided by the present disclosure can comprise a nucleic acid encoding for a dual receptor binding construct comprising a virus-like particle.

A nucleic acid provided by the present disclosure can encode for an IL-2Rβ ligand comprising an amino acid sequence of any one of SEQ ID NOS: 1-572, 575-655, 661-891, 900-926, 930-937, and 9301-9315, a truncated amino acid sequence of any one of SEQ ID NOS: 1-572, 575-655, 661-891, 900-926, 930-937, and 9301-9315, a substituted amino acid sequence of any one of SEQ ID NOS: 1-572, 575-655, 661-891, 900-926, 930-937, and 9301-9315, or can encode for an amino acid sequence comprising an amino acid sequence having greater than 60%, greater than 70%, greater than 80%, greater than 85%, greater than 90%, or greater than 95% sequence similarity to any one of SEQ ID NOS: 1-572, 575-655, 661-891, 900-926, 930-937, and 9301-9315.

A nucleic acid provided by the present disclosure can encode for an IL-2Rβ ligand comprising an amino acid sequence of SEQ ID NO: 395, or can encode for an amino acid sequence comprising an amino acid sequence having greater than 60%, greater than 70%, greater than 80%, greater than 85%, greater than 90%, or greater than 95% sequence similarity to any one of SEQ ID NO: 395.

A nucleic acid provided by the present disclosure can encode for an IL-7Rα ligand comprising an amino acid sequence of any one of SEQ ID NOS: 2001-2410, 2601, 2602, and 9320-9332, a truncated amino acid sequence of any one of SEQ ID NOS: 2001-2410, 2601, 2602, and 9320-9332, a substituted amino acid sequence of any one of SEQ ID NOS: 2001-2410, 2601, 2602, and 9320-9332, or can encode for an amino acid sequence comprising an amino acid sequence having greater than 60%, greater than 70%, greater than 80%, greater than 85%, greater than 90%, or greater than 95% sequence similarity to any one of SEQ ID NOS: 2001-2410, 2601, 2602, and 9320-9332.

A nucleic acid provided by the present disclosure can encode for an IL-7Rα ligand comprising an amino acid sequence of SEQ ID NO: 1204, or can encode for an amino acid sequence comprising an amino acid sequence having greater than 60%, greater than 70%, greater than 80%, greater than 85%, greater than 90%, or greater than 95% sequence similarity to SEQ ID NO: 1204.

A nucleic acid provided by the present disclosure can encode for an Rγc ligand comprising an amino acid sequence of any one of SEQ ID NOS: 1001-1215, 1601-1613, and 9340-9353, a truncated amino acid sequence of any one of SEQ ID NOS: 1001-1215, a substituted amino acid sequence of any one of SEQ ID NOS: 1001-1215, 1601-1613, and 9340-9353, or can encode for an amino acid sequence comprising an amino acid sequence having greater than 60%, greater than 70%, greater than 80%, greater than 85%, greater than 90%, or greater than 95% sequence similarity to any one of SEQ ID NOS: 1001-1215, 1601-1613, and 9340-9353.

A nucleic acid provided by the present disclosure can encode for an Rγc ligand comprising an amino acid sequence of any one of SEQ ID NO: 1204, or can encode for an amino acid sequence comprising an amino acid sequence having greater than 60%, greater than 70%, greater than 80%, greater than 85%, greater than 90%, or greater than 95% sequence similarity to any one of SEQ ID NO: 1204.

A nucleic acid provided by the present disclosure can encode for an IL-2Rβγc ligand comprising an amino acid sequence of any one of SEQ ID NOS: 4001-4007, 4070-4085, and 4090-4099, or can encode for an amino acid sequence comprising an amino acid sequence having greater than 60%, greater than 70%, greater than 80%, greater than 85%, greater than 90%, or greater than 95% sequence similarity to any one of SEQ ID NOS: 4001-4007, 4070-4085, and 4090-4099.

A nucleic acid provided by the present disclosure can encode for an IL-2Rβγc ligand fusion protein comprising an amino acid sequence of SEQ ID NO: 4001, or can encode for an amino acid sequence comprising an amino acid sequence having greater than 60%, greater than 70%, greater than 80%, greater than 85%, greater than 90%, or greater than 95% sequence similarity to SEQ ID NO: 4001.

A nucleic acid provided by the present disclosure can encode for an IL-2Rβγc ligand construct comprising an IL-2Rβ ligand comprising an amino acid sequence of SEQ ID NO: 395 or an amino acid sequence comprising an amino acid sequence having greater than 60%, greater than 70%, greater than 80%, greater than 85%, greater than 90%, or greater than 95% sequence similarity to SEQ ID NO: 395; and an Rγc ligand comprising an amino acid sequence of SEQ ID NO: 1204 or an amino acid sequence comprising an amino acid sequence having greater than 60%, greater than 70%, greater than 80%, greater than 85%, greater than 90%, or greater than 95% sequence similarity to SEQ ID NO: 1204.

A nucleic acid provided by the present disclosure can encode for an IL-7Rαγc ligand comprising an amino acid sequence of any one of SEQ ID NOS: 4021-4028, or can encode for an amino acid sequence comprising an amino acid sequence having greater than 60%, greater than 70%, greater than 80%, greater than 85%, greater than 90%, or greater than 95% sequence similarity to any one of SEQ ID NOS: 4021-4028.

A nucleic acid provided by the present disclosure can encode for an IL-7Rαγc ligand fusion protein comprising an amino acid sequence of SEQ ID NO: 4021, or can encode for an amino acid sequence comprising an amino acid sequence having greater than 60%, greater than 70%, greater than 80%, greater than 85%, greater than 90%, or greater than 95% sequence similarity to SEQ ID NO: 4021.

A nucleic acid provided by the present disclosure can encode for an IL-7Rαγc ligand construct comprising an IL-7Rα ligand comprising an amino acid sequence of SEQ ID NO: 2407 or an amino acid sequence comprising an amino acid sequence having greater than 60%, greater than 70%, greater than 80%, greater than 85%, greater than 90%, or greater than 95% sequence similarity to SEQ ID NO: 2407; and an Rγc ligand comprising an amino acid sequence of SEQ ID NO: 1204 or an amino acid sequence comprising an amino acid sequence having greater than 60%, greater than 70%, greater than 80%, greater than 85%, greater than 90%, or greater than 95% sequence similarity to SEQ ID NO: 1204.

A nucleic acid provided by the present disclosure can encode for a dual receptor binding ligand or a dual receptor binding ligand construct comprising an IL-2Rβ ligand having an amino acid sequence of SEQ ID NOS: 1-572, 575-655, 661-891, 900-926, 930-937, and 9301-9315 or an amino acid sequence comprising an amino acid sequence having greater than 60%, greater than 70%, greater than 80%, greater than 85%, greater than 90%, or greater than 95% sequence similarity to SEQ ID NOS: 1-572, 575-655, 661-891, 900-926, 930-937, and 9301-9315, an IL-7Rα ligand having an amino acid sequence of SEQ ID NOS: 2001-2410, 2601, 2602, and 9320-9332 or an amino acid sequence comprising an amino acid sequence having greater than 60%, greater than 70%, greater than 80%, greater than 85%, greater than 90%, or greater than 95% sequence similarity to SEQ ID NOS: 2001-2410, 2601, 2602, and 9320-9332 and an Rγc ligand comprising an amino acid sequence of any one of SEQ ID NOS: 1001-1215, 1601-1613, and 9340-9353 or an amino acid sequence comprising an amino acid sequence having greater than 60%, greater than 70%, greater than 80%, greater than 85%, greater than 90%, or greater than 95% sequence similarity to SEQ ID NOS: 1001-1215, 1601-1613, and 9340-9353.

A nucleic acid provided by the present disclosure can encode for a dual receptor binding ligand or a dual receptor binding ligand construct comprising an IL-2Rβ ligand having an amino acid sequence of SEQ ID NO: 395 or an amino acid sequence comprising an amino acid sequence having greater than 60%, greater than 70%, greater than 80%, greater than 85%, greater than 90%, or greater than 95% sequence similarity to SEQ ID NO: 395; an IL-7Rα ligand having an amino acid sequence of SEQ ID NO: 2407 or an amino acid sequence comprising an amino acid sequence having greater than 60%, greater than 70%, greater than 80%, greater than 85%, greater than 90%, or greater than 95% sequence similarity to SEQ ID NO: 2407; and an Rγc ligand comprising an amino acid sequence of SEQ ID NO: 1204 or an amino acid sequence comprising an amino acid sequence having greater than 60%, greater than 70%, greater than 80%, greater than 85%, greater than 90%, or greater than 95% sequence similarity to SEQ ID NO: 1204.

A nucleic acid provided by the present disclosure can encode a dual receptor binding ligand or dual receptor binding ligand construct provided by the present disclosure such as a linear dual receptor binding ligand comprising an amino acid sequence of any one of SEQ ID NOS: 4041-4058 or comprising an amino acid sequence having greater than 60%, greater than 70%, greater than 80%, greater than 85%, greater than 90%, or greater than 95% sequence similarity to any one of SEQ ID NOS: 4041-4058.

A nucleic acid provided by the present disclosure can encode for a tandem IL-2Rβγc ligand comprising two or more IL-2Rβγc ligands provided by the present disclosure.

A nucleic acid provided by the present disclosure can encode for a tandem IL-7Rαγc ligand comprising two or more IL-7Rαγc ligands provided by the present disclosure.

Aspects of the invention include expression vectors comprising a nucleic acid encoding an IL-2Rβ ligand, an IL-7Rα ligand, an Rγc ligand, an IL-2Rβγc ligand, an IL-7Rαγc ligand, a tandem IL-2Rβγc ligand, a tandem IL-7Rαγc ligand, a dual receptor binding ligand, or a dual ligand construct provided by the present disclosure.

Aspects of the invention further include a host cell comprising an expression vector comprising a nucleic acid encoding an IL-2Rβ ligand, an IL-7Rα ligand, an Rγc ligand, an IL-2Rβγc ligand, an IL-7Rαγc ligand, a tandem IL-2Rβγc ligand, a tandem IL-7Rαγc ligand, a dual receptor binding ligand, or a dual receptor binding construct provided by the present disclosure.

Methods provided by the present disclosure include methods of making an IL-2Rβ ligand, an IL-7Rα ligand, an Rγc ligand, an IL-2Rβγc ligand, an IL-7Rαγc ligand, a tandem IL-2Rβγc ligand, a tandem IL-7Rαγc ligand, a dual receptor binding ligand, or a dual receptor binding construct provided by the present disclosure, comprising culturing a host cell, wherein the host cell comprises an expression vector comprising a nucleic acid encoding an IL-2Rβ ligand, an IL-7Rα ligand, an Rγc ligand, an IL-2Rβγc ligand, an IL-7Rαγc ligand, a tandem IL-2Rβγc ligand, a tandem IL-7Rαγc ligand, a t dual receptor binding ligand, or a dual receptor binding construct provided by the present disclosure, under conditions where the IL-2Rβ ligand, IL-7Rα ligand, Rγc ligand, IL-7Rαγc ligand, tandem IL-2Rβγc ligand, tandem IL-7Rαγc ligand, dual receptor binding ligand, or dual receptor binding construct is expressed, and recovering the expressed IL-2Rβ ligand, IL-7Rα ligand, Rγc ligand, IL-7Rαγc ligand, tandem IL-2Rβγc ligand, tandem IL-7Rαγc ligand, dual receptor binding ligand, or dual receptor binding construct.

ASPECTS OF THE INVENTION

The invention is further defined by the following aspects.

Aspect 1. A dual receptor binding compound, comprising:
an IL-2Rβγc ligand and an IL-7Rαγc ligand, wherein,
the IL-2Rβγc ligand comprises an IL-2Rβ ligand and an Rγc ligand;
the IL-7Rαγc ligand comprises an IL-7Rα ligand and an Rγc ligand; or
an IL-2Rβ ligand, an IL-7Rα ligand, and an Rγc ligand.

Aspect 2. The compound of aspect 1, wherein the IL-2Rβγc ligand has the structure of Formula (101):

-B-L-G- (101)

wherein,
B comprises an IL-2Rβ ligand;
G comprises an Rγc ligand; and
L is a ligand linker.

Aspect 3. The compound of aspect 2, wherein the C-terminus of the IL-2Rβ ligand is bound to the ligand linker.

Aspect 4. The compound of aspect 2, wherein the N-terminus of the IL-2Rβ ligand is bound to the ligand linker.

Aspect 5. The compound of any one of aspects 2 to 4, wherein the C-terminus of the Rγc ligand is bound to the ligand linker.

Aspect 6. The compound of any one of aspects 2 to 4, wherein the N-terminus of the Rγc ligand is bound to the ligand linker.

Aspect 7. The compound of any one of aspects 2 to 6, wherein the ligand linker comprises a peptidyl ligand linker.

Aspect 8. The compound of any one of aspects 2 to 7, wherein,
the IL-2Rβ ligand comprises two cysteines and the two cysteines are bonded together through a disulfide bond; and the Rγc ligand comprises two cysteines and the two cysteines are bonded together through a disulfide bond; and/or the IL-2Rβ ligand comprises a cysteine and the Rγc ligand comprises a cysteine, where the two cysteines are bonded together through a disulfide bond.

Aspect 9. The compound of any one of aspects 1 to 8, wherein the IL-7Rαγc ligand has the structure of Formula (102):

-A-L-G-                                       (102)

wherein,
A comprises an IL-7Rα ligand;
G comprises an Rγc ligand; and
L is a ligand linker.

Aspect 10. The compound of aspect 9, wherein the C-terminus of the IL-7Rα ligand is bound to the ligand linker.

Aspect 11. The compound of aspect 9, wherein the N-terminus of the IL-7Rα ligand is bound to the ligand linker.

Aspect 12. The compound of any one of aspects 9 to 11, wherein the C-terminus of the Rγc ligand is bound to the ligand linker.

Aspect 13. The compound of any one of aspects 9 to 11, wherein the N-terminus of the Rγc ligand is bound to the ligand linker.

Aspect 14. The compound of any one of aspects 9 to 13, wherein the ligand linker comprises a peptidyl ligand linker.

Aspect 15. The compound of any one of aspects 1 to 14, wherein,
the IL-7Rα ligand comprises two cysteines and the two cysteines are bonded together through a disulfide bond;
the Rγc ligand comprises two cysteines and the two cysteines are bonded together through a disulfide bond; and/or
the IL-7Rα ligand comprises a cysteine and the Rγc ligand comprises a cysteine, where the two cysteines are bonded together through a disulfide bond.

Aspect 16. The compound of aspect 1, wherein the dual receptor binding ligand comprises a linear dual receptor binding ligand.

Aspect 17. The compound of aspect 16, wherein the linear dual receptor binding ligand has the structure of any one of Formula (103a)-(103f):

-B-L$^1$-A-L$^2$-G-                             (103a)

-B-L$^1$-G-L$^2$-A-                             (103b)

-A-L$^1$-G-L$^2$-B-                             (103c)

-A-L$^1$-B-L$^2$-G-                             (103d)

-G-L$^1$-A-L$^2$-B-                             (103e)

-G-L$^1$-B-L$^2$-A-                             (103f)

wherein,
B is an IL-2Rβ ligand;
A is an IL-7Rα ligand;
G is an Rγc ligand;
each of L$^1$ and L$^2$ is independently a ligand linker.

Aspect 18. The compound of aspect 17, wherein each of the IL-2Rβ ligand, the IL-7Rα ligand and the Rγc ligand is independently in the N/C-orientation or in the C/N-orientation.

Aspect 19. The compound of any one of aspects 17 to 18, wherein each of L$^1$ and L$^2$ is independently selected from a peptidyl ligand linker.

Aspect 20. The compound of aspect 1, wherein the dual receptor binding ligand comprises a branched dual receptor binding ligand.

Aspect 21. The compound of aspect 20, wherein the branched dual receptor binding ligand has the structure of any one of Formula (104a)-(104d):

-L$^3${-(L$^1$)$_n$-A}{-(L$^1$)$_n$-B}{-(L$^1$)$_n$-G}           (104a)

L$^3${-(L$^1$)$_n$-A-}{-(L$^1$)$_n$-B}{-(L$^1$)$_n$-G}           (104b)

L$^3${-(L$^1$)$_n$-A}{-(L$^1$)$_n$-B-}{-(L$^1$)$_n$-G}           (104c)

L$^3${-(L$^1$)$_n$-A}{-(L$^1$)$_n$-B}{-(L$^1$)$_n$-G-}           (104d)

wherein,
n is 0 or 1;
A is an IL-7Rα ligand;
B is an IL-2Rβ ligand;
G is an Rγc ligand;
each L$^1$ is independently a ligand linker; and
L$^3$ is a trimeric core.

Aspect 22. The compound of aspect 21, wherein,
the IL-2Rβ ligand comprises two cysteines and the two cysteines are bonded together through a disulfide bond;
the IL-7Rα ligand comprises two cysteines and the two cysteines are bonded together through a disulfide bond; and/or
the Rγc ligand comprises two cysteines and the two cysteines are bonded together through a disulfide bond.

Aspect 23. The compound of any one of aspects 21 to 22, wherein each of the IL-2Rβ ligand, the IL-7Rα ligand and the Rγc ligand is independently bonded to the trimeric core in the N/C-orientation or in the C/N-orientation.

Aspect 24. The compound of aspect 21, wherein the branched dual receptor binding ligand has the structure of any one of Formula (105a)-(105b):

-L$^3${-(L$^1$)$_n$-A}$_a${-(L$^1$)$_n$-B}$_b${-(L$^1$)$_n$-G}$_g$         (105a)

L$^3${-(L$^1$)$_n$-A}$_a${-(L$^1$)$_n$-B}$_b${-(L$^1$)$_n$-G}$_g$         (105a)

wherein,
n is 0 or 1;
each of a, b, and g is independently an integer from 1 to 3;
A is an IL-7Rα ligand;
B is an IL-2Rβ ligand;
G is an Rγc ligand;
each L$^1$ is independently a ligand linker; and
L$^3$ is a trifunctional core.

Aspect 25. The compound of aspect 24, wherein each of the IL-2Rβ ligand, the IL-7Rα ligand and the Rγc ligand is independently bonded to the trimeric core in the N/C-orientation or in the C/N-orientation.

Aspect 26. The compound of any one of aspects 24 to 25, wherein,
the IL-2Rβ ligand comprises two cysteines and the two cysteines are bonded together through a disulfide bond;
the IL-7Rα ligand comprises two cysteines and the two cysteines are bonded together through a disulfide bond; and/or
the Rγc ligand comprises two cysteines and the two cysteines are bonded together through a disulfide bond.

Aspect 27. The compound of any one of aspects 1 to 26, wherein the IL-2Rβ ligand comprises an amino acid sequence of any one of SEQ ID NOS: 1-565.

Aspect 28. The compound of any one of aspects 1 to 27, wherein the Il-2Rβ ligand comprises from 1 to 5 conservative amino acid substitutions.

Aspect 29. The compound of any one of aspects 1 to 28, wherein the Il-2Rβ ligand comprises from 1 to 5 amino acid substitutions.

Aspect 30. The compound of any one of aspects 1 to 29, wherein IL-2Rβ ligand has greater than 60% sequence similarity to any one of SEQ ID NOS: 1-565.

Aspect 31. The compound of any one of aspects 1 to 30, wherein the IL-2Rβ ligand comprises a truncated amino acid sequence of any one of SEQ ID NOS: 1-565.

Aspect 32. The compound of any one of aspects 1 to 31, wherein each of the C-terminus and/or the N-terminus of the IL-2Rβ ligand independently comprises from 2 to 10 flanking amino acids.

Aspect 33. The compound of any one of aspects 1 to 32, wherein the amino acid sequence of the Rγc ligand independently comprises from 1 to 4 glycines (G) on the N-terminus, on the C-terminus, or on both the N- and C-termini.

Aspect 34. The compound of any one of aspects 1 to 33, wherein the IL-2Rβ ligand binds to the hIL-2Rβ subunit with an $IC_{50}$ of less than 100 μM.

Aspect 35. The compound of any one of aspects 1 to 34, wherein the IL-2Rβ ligand binds to the hIL-2Rβ subunit with an $IC_{50}$ of less than 10 μM.

Aspect 36. The compound of any one of aspects 1 to 35, wherein the IL-2Rβ ligand binds to a specific binding site of the IL-7Rα subunit, wherein,
(1) a group of IL-2Rβ ligands bind to each specific binding site on the IL-2Rβ subunit with an $IC_{50}$ of less than 10 μM;
(2) each of the IL-2Rβ ligands within the group competitively bind to the specific binding site on the IL-2Rβ subunit with each of the other IL-2Rβ ligands within the group;
(3) a peptide having the amino acid sequence of SEQ ID NO: 219 does not compete for binding to a specific binding site on the IL-2Rβ subunit with the peptides within the group of IL-2Rβ ligands; and
(4) IL-2Rβ ligands having SEQ ID NOS: 154, 180, and 209 do not bind competitively with IL-2 binding to IL-2Rβ, indicating that this IL-2Rβ ligand binding site is distinct from that of IL-2.

Aspect 37. The compound of any one of aspects 1 to 36, wherein the IL-2Rβ ligand is selected from an amino acid sequence of any one of SEQ ID NOS: 395.

Aspect 38. The compound of any one of aspects 1 to 37, wherein the IL-2Rβ ligand is selected from an amino acid sequence having greater than 60% sequence similarity to SEQ ID NO: 395.

Aspect 39. The compound of any one of aspects 1 to 38, wherein the IL-7Rα ligand comprises an amino acid sequence of any one of SEQ ID NOS: 2001-2410.

Aspect 40. The compound of any one of aspects 1 to 39, wherein the IL-7Rα ligand comprises from 1 to 5 amino acid substitutions.

Aspect 41. The compound of any one of aspects 1 to 40, wherein IL-7Rα ligand has greater than 60% sequence similarity to any one of SEQ ID NOS: 2001-2410.

Aspect 42. The compound of any one of aspects 1 to 41, wherein the IL-7Rα ligand comprises from 1 to 5 conservative amino acid substitutions.

Aspect 43. The compound of any one of aspects 1 to 42, wherein IL-7Rα ligand has greater than 80% sequence similarity to any one of SEQ ID NOS: 2001-2410.

Aspect 44. The compound of any one of aspects 1 to 43, wherein the IL-7Rα ligand comprises a truncated amino acid sequence.

Aspect 45. The compound of any one of aspects 1 to 44, wherein each of the C-terminus and/or the N-terminus of the IL-7Rα ligand independently comprises from 2 to 10 flanking amino acids.

Aspect 46. The compound of any one of aspects 1 to 45, wherein the amino acid sequence of the Rγc ligand independently comprises from 1 to 4 glycines (G) on the N-terminus, on the C-terminus, or on both the N- and C-termini.

Aspect 47. The compound of any one of aspects 1 to 46, wherein the IL-7Rα ligand binds to the hIL-7Rα subunit with an $IC_{50}$ of less than 100 μM.

Aspect 48. The compound of any one of aspects 1 to 47, wherein the IL-2Rβ ligand binds to the hIL-7Rα subunit with an $IC_{50}$ of less than 10 μM.

Aspect 49. The compound of any one of aspects 1 to 48, wherein the IL-7Rα ligand binds to a specific binding site of the IL-7Rα subunit, wherein,
(1) a group of IL-7Rα ligands bind to each specific binding site on the IL-7Rα subunit with an $IC_{50}$ of less than 10 μM;
(2) each of the IL-7Rα ligands within the group competitively bind to the specific binding site on the IL-7Rα subunit with each of the other IL-7Rα ligands within the group;
(3) a peptide having the amino acid sequence of SEQ ID NO: 1204 does not compete for binding to a specific binding site on the IL-7Rα subunit with the peptides within the group of IL-7Rα ligands; and
(4) IL-7Rα ligands having SEQ ID NOS: 2159, 2043, 2104, 2402, and 2313 do not bind competitively with IL-7 binding to IL-7Rα, indicating that this IL-7Rα ligand binding site is distinct from that of IL-7.

Aspect 50. The compound of any one of aspects 1 to 49, wherein the IL-2Rβ ligand has an amino acid sequence of SEQ ID NO: 2407.

Aspect 51. The compound of any one of aspects 1 to 50, wherein the IL-2Rβ ligand is selected from an amino acid sequence having greater than 60% sequence similarity to SEQ ID NO: 2407.

Aspect 52. The compound of any one of aspects 1 to 51, wherein the Rγc ligand comprises an amino acid sequence of any one of SEQ ID NOS: 1001-1215.

Aspect 53. The compound of any one of aspects 1 to 52, wherein the Rγc ligand comprises from 1 to 5 amino acid substitutions.

Aspect 54. The compound of any one of aspects 1 to 53, wherein Rγc ligand has greater than 60% sequence similarity to any one of SEQ ID NOS: 1001-1215.

Aspect 55. The compound of any one of aspects 1 to 54, wherein the Rγc ligand comprises from 1 to 5 conservative amino acid substitutions.

Aspect 56. The compound of any one of aspects 1 to 55, wherein Rγc ligand has greater than 60% sequence similarity to any one of SEQ ID NOS: 1001-1215.

Aspect 57. The compound of any one of aspects 1 to 56, wherein the Rγc ligand comprises a truncated amino acid sequence.

Aspect 58. The compound of any one of aspects 1 to 57, wherein each of the C-terminus and/or the N-terminus of the Rγc ligand independently comprises from 2 to 10 flanking amino acids.

Aspect 59. The compound of any one of aspects 1 to 58, wherein the amino acid sequence of the Rγc ligand independently comprises from 1 to 4 glycines (G) on the N-terminus, on the C-terminus, or on both the N- and C-termini.

Aspect 60. The compound of any one of aspects 1 to 59, wherein the Rγc ligand binds to the Rγc subunit with an $IC_{50}$ of less than 100 μM.

Aspect 61. The compound of any one of aspects 1 to 60, wherein the Rγc ligand binds to the Rγc subunit with an $IC_{50}$ of less than 10 μM.

Aspect 62. The compound of any one of aspects 1 to 61, wherein the Rγc ligand binds to a specific binding site of the Rγc subunit, wherein, (1) a group of Rγc ligands bind to the specific binding site on the Rγc subunit with an $IC_{50}$ of less than 10 μM; (2) Rγc ligands within the group competitively bind to the specific binding site on the Rγc subunit with each of the other Rγc ligands within the group; and (3) Rγc ligands within the group do not compete for binding to the specific binding site with an Rγc ligand having the amino acid sequence of SEQ ID NO: 1128.

Aspect 63. The compound of any one of aspects 1 to 62, wherein the Rγc ligand has the amino acid sequence of any one of SEQ ID NO: 1204.

Aspect 64. The compound of any one of aspects 1 to 63, wherein the Rγc ligand is selected from an amino acid sequence of having greater than 60% sequence similarity to SEQ ID NO: 1204.

Aspect 65. The compound of any one of aspects 2 to 64, wherein the ligand linker comprises a peptidyl ligand linker.

Aspect 66. The compound of aspect 65, wherein the peptidyl ligand linker comprises from 2 to 20 amino acids.

Aspect 67. The compound of any one of aspects 64 to 65, wherein the peptidyl ligand linker has a length from 5 Å to 200 Å.

Aspect 68. The compound of any one of aspects 64 to 67, wherein each ligand linker is independently selected from an amino acid sequence of any one of SEQ ID NOS: 9380-9386.

Aspect 69. The compound of any one of aspects 2 to 64, wherein the ligand linker is a synthetic ligand linker.

Aspect 70. The compound of any one of aspects 1 to 69, wherein the IL-2Rβγc ligand comprises: an IL-2Rβ ligand of any one of SEQ ID NOS: 1-565; and an Rγc ligand of any one of SEQ ID NOS: 1001-1215.

Aspect 71. The compound of aspect 70, wherein the IL-2Rβγc ligand comprises: an IL-2Rβ ligand comprising an amino acid sequence of SEQ ID NO: 395, a substituted amino acid sequence of SEQ ID NO: 395, a truncated amino acid sequence of SEQ ID NO: 395; or a combination of any of the foregoing; and an Rγc ligand comprising an amino acid sequence of SEQ ID NO: 1204, a substituted amino acid sequence of SEQ ID NO: 1204, a truncated amino acid sequence of SEQ ID NO: 1204; or a combination of any of the foregoing.

Aspect 72. The compound of aspect 71, wherein the ligand comprises a ligand linker selected from an amino acid sequence of any one of SEQ ID NOS: 9380-9386.

Aspect 73. The compound of aspect 72, wherein the ligand linker has the amino acid sequence of SEQ ID NO: 9394.

Aspect 74. The compound of any one of aspects 70 to 73, wherein, the IL-2Rβ ligand has the amino acid sequence of SEQ ID NO: 395; and the Rγc ligand has the amino acid sequence of SEQ ID NO: 1204.

Aspect 75. The compound of aspect 74, wherein the ligand comprises a ligand linker selected from an amino acid sequence of any one of SEQ ID NOS: 9380-9386.

Aspect 76. The compound of any one of aspects 70 to 75, wherein the IL-2Rβγc ligand has the amino acid sequence of any one of SEQ ID NOS: 4001-4007.

Aspect 77. The compound of any one of aspects 70 to 75, wherein the IL-2Rβγc ligand has the amino acid sequence of SEQ ID NO: 4001.

Aspect 78. The compound of any one of aspects 70 to 77, wherein the IL-2Rβγc ligand is a full IL-2R agonist.

Aspect 79. The compound of any one of aspects 70 to 77, wherein the IL-2Rβγc ligand is a partial IL-2R agonist.

Aspect 80. The compound of any one of aspects 70 to 77, wherein the IL-2Rβγc ligand is an IL-2R antagonist.

Aspect 81. The compound of any one of aspects 1 to 80, wherein the IL-7Rαγc ligand comprises: an IL-7Rα ligand of any one of SEQ ID NOS: 2001-2410; and an Rγc ligand of any one of SEQ ID NOS: 1001-1215.

Aspect 82. The compound of aspect 81, wherein the IL-7Rαγc ligand comprises: an IL-7Rα ligand comprising an amino acid sequence of SEQ ID NO: 2407 a substituted amino acid sequence of SEQ ID NO: 2407, a truncated amino acid sequence of SEQ ID NO: 2407; or a combination of any of the foregoing; and an Rγc ligand comprising an amino acid sequence of SEQ ID NO: 1204 a substituted amino acid sequence of SEQ ID NO: 1204, a truncated amino acid sequence of SEQ ID NO: 1204; or a combination of any of the foregoing.

Aspect 83. The compound of any one of aspects 81 to 82, wherein the ligand comprises a ligand linker, wherein the ligand linker is selected from an amino acid sequence of any one of SEQ ID NOS: 9380-9386.

Aspect 84. The compound of aspect 83, wherein the ligand linker has the amino acid sequence of SEQ ID NO: 9394.

Aspect 85. The compound of any one of aspects 81 to 84, wherein, the IL-7Rα ligand has the amino acid sequence of SEQ ID NO: 2407; and the Rγc ligand has the amino acid sequence of SEQ ID NO: 1204.

Aspect 86. The compound of aspect 85, wherein each ligand linker is independently selected from an amino acid sequence of any one of SEQ ID NOS: 9380-9386.

Aspect 87. The compound of any one of aspects 81 to 86, wherein the IL-7Rαγc ligand has the amino acid sequence of any one of SEQ ID NOS: 4021-4028.

Aspect 88. The compound of any one of aspects 81 to 87, wherein the IL-7Rαγc ligand has the amino acid sequence of SEQ ID NO: 4021.

Aspect 89. The compound of any one of aspects 81 to 88, wherein the IL-7Rαγc ligand is a full IL-7R agonist.

Aspect 90. The compound of any one of aspects 81 to 88, wherein the IL-7Rαγc ligand is a partial IL-7R agonist.

Aspect 91. The compound of any one of aspects 81 to 88, wherein the IL-7Rαγc ligand is an IL-7R antagonist.

Aspect 92 The compound of aspect 1, wherein the dual receptor binding ligand comprises: an IL-2Rβ ligand of any one of SEQ ID NOS: 1-565; an IL-7Rα ligand of any one of SEQ ID NOS: 2001-2410; and an Rγc ligand of any one of SEQ ID NOS: 1001-1215.

Aspect 93. The compound of aspect 92, wherein the dual receptor binding ligand comprises: an IL-2Rβ ligand comprising an amino acid sequence of SEQ ID NO: 395, a substituted amino acid sequence of SEQ ID NO: 395, a truncated amino acid sequence of SEQ ID NO: 395; or a combination of any of the foregoing; an IL-7Rα ligand comprising an amino acid sequence of SEQ ID NO: 2407, a substituted amino acid sequence of SEQ ID NO: 2407, a truncated amino acid sequence of SEQ ID NO: 2407; or a combination of any of the foregoing; and an Rγc ligand comprises an amino acid sequence of SEQ ID NO: 1204, a substituted amino acid sequence of SEQ ID NO: 1204, a truncated amino acid sequence of SEQ ID NO: 1204; or a combination of any of the foregoing.

Aspect 94. The compound of any one of aspects 92 to 93, wherein the IL-2Rβ ligand comprises an amino acid sequence of SEQ ID NO: 395.

Aspect 95. The compound of any one of aspects 92 to 94, wherein the IL-7Rα ligand comprises an amino acid sequence of SEQ ID NO: 2407.

Aspect 96. The compound of any one of aspects 92 to 95, wherein the Rγc ligand comprises an amino acid sequence of SEQ ID NO: 1204.

Aspect 97. The compound of any one of aspects 92 to 96, wherein the dual receptor binding ligand is a linear dual receptor binding ligand.

Aspect 98. The compound of aspect 97, wherein the linear dual receptor binding ligand comprises two ligand linkers, wherein each ligand linker is independently selected from an amino acid sequence of any one of SEQ ID NOS: 9380-9386.

Aspect 99. The compound of aspect 97, wherein each ligand linker has the amino acid sequence of SEQ ID NO: 9394.

Aspect 100. The compound of any one of aspects 92 to 99, wherein the linear dual receptor binding ligand has an amino acid sequence selected from any one of SEQ ID NOS: 4041-4058.

Aspect 101. The compound of aspect 92, wherein the linear dual receptor binding ligand has an amino acid sequence having greater than 60% sequence similarity to any one of SEQ ID NOS: 4041-4058.

Aspect 102. The compound of any one of aspects 92 to 101, wherein the dual receptor binding ligand is a branched dual receptor binding ligand.

Aspect 103. The compound of any one of aspects 92 to 102, wherein the dual receptor binding ligand is a full IL-2R agonist and a full IL-7R agonist.

Aspect 104. The compound of any one of aspects 92 to 102, wherein the dual receptor binding ligand is a partial IL-2R agonist and a partial IL-7R agonist.

Aspect 105. The compound of any one of aspects 92 to 102, wherein the dual receptor binding ligand is an IL-2R antagonist and an IL-7R antagonist.

Aspect 106. The compound of aspect 1, wherein the compound binds to each of IL-2R and IL-7R with an $IC_{50}$ less than 100 μm.

Aspect 107. The compound of aspect 106, wherein the dual receptor compound comprises:
the IL-2Rβγc ligand and the IL-7Rαγc ligand bound to a construct partner; or
the dual receptor binding ligand bound to a construct partner.

Aspect 108. The compound of aspect 106, wherein the dual receptor compound comprises the Il-2Rβγc ligand and the IL-7Rαγc ligand bound to a construct partner.

Aspect 109. The compound of aspect 108, wherein each of the IL-2Rβγc ligand and the IL-7Rαγc ligand is bound to the construct partner through the N-terminus of the respective ligand.

Aspect 110 The compound of aspect 108, wherein each of the IL-2Rβγc ligand and the IL-7Rαγc ligand is bound to the construct partner through the C-terminus of the respective ligand.

Aspect 111. The compound of any one of aspects 106 to 110, wherein the dual receptor compound comprises the dual receptor binding ligand bound to a construct partner.

Aspect 112. The compound of aspect 111, wherein the dual receptor binding ligand comprises a linear dual receptor binding ligand.

Aspect 113. The compound of aspect 112, wherein the linear dual receptor binding ligand is bound to the construct partner through the N-terminus of the linear dual receptor binding ligand.

Aspect 114. The compound of aspect 112, wherein the linear dual receptor binding ligand is bound to the construct partner through the C-terminus of the linear dual receptor binding ligand.

Aspect 115. The compound of aspect 111, wherein the dual receptor binding ligand comprises a branched dual receptor binding ligand.

Aspect 116. The compound of aspect 115, wherein the branched dual receptor binding ligand is bound to the construct partner through the IL-2Rβ ligand of the branched dual receptor binding ligand.

Aspect 117. The compound of aspect 115, wherein the branched dual receptor binding ligand is bound to the construct partner through the IL-7Rα ligand of the branched dual receptor binding ligand.

Aspect 118. The compound of aspect 115, wherein the branched dual receptor binding ligand is bound to the construct partner through the Rγc ligand of the branched dual receptor binding ligand.

Aspect 119. The compound of aspect 115, wherein the branched dual receptor binding ligand is bound to the construct partner through the core of the branched dual receptor binding ligand.

Aspect 120. The compound of any one of aspects 107 to 119, wherein each of the IL-2Rβγc ligand, the IL-7Rαγc ligand, and/or the dual receptor binding ligand is independently bound to the construct partner through a construct linker.

Aspect 121. The compound of aspect 120, wherein the construct linker comprises a peptidyl construct linker.

Aspect 122. The compound of aspect 121, wherein the peptidyl construct linker comprises from 2 to 200 amino acids.

Aspect 123. The compound of any one of aspects 121 to 122, wherein the peptidyl construct linker has a length from 5 Å to 200 Å.

Aspect 124. The compound of any one of aspects 121 to 123, wherein the peptidyl construct linker comprises an amino acid sequence of any one of SEQ ID NOS: 9380-9386.

Aspect 125. The compound of any one of aspects 120 to 124, wherein the construct linker comprises a cleavable construct linker.

Aspect 126. The compound of any one of aspects 107 to 125, wherein, the construct partner comprises a polypeptide; and a ligand is bound to the C-terminus and/or to the N-terminus of the polypeptide.

Aspect 127. The compound of any one of aspects 107 to 125, wherein, the construct partner comprises a polypeptide; and a ligand is bound to an amino acid side chain of the polypeptide.

Aspect 128. The compound construct of any one of aspects 107 to 125, wherein, the construct partner comprises a polypeptide; and a ligand is incorporated into the polypeptide.

Aspect 129. The compound of any one of aspects 107 to 128, wherein the construct partner comprises a compound configured to impart a desired pharmacokinetic property in the systemic circulation of a patient.

Aspect 130. The compound of any one of aspects 107 to 129, wherein the construct partner comprises a compound configured to impart a desired biodistribution property in the body of a patient.

Aspect 131. The compound of any one of aspects 107 to 128, wherein the construct partner is selected from a polymer, a polypeptide, an Fc-fragment, an immunoglobulin fragment, and an antibody.

Aspect 132. The compound of any one of aspects 107 to 131, wherein the construct partner comprises a vaccine.

Aspect 133. The compound of any one of aspects 107 to 132, wherein the construct partner comprises a viral surface antigen or a virus like particle.

Aspect 134. The compound of any one of aspects 107 to 133, wherein the construct partner is selected from a human serum albumin, a polypeptide, and a polyethylene glycol.

Aspect 135. The compound of any one of aspects 106 to 134, wherein the compound comprises a recombinant fusion protein.

Aspect 136. The compound of aspect 135, wherein the fusion protein comprises a hIgG-Fc recombinant fusion protein.

Aspect 137. The compound of aspect 135, wherein the fusion protein comprises a hIgG1-Fc recombinant fusion protein.

Aspect 138. The compound of aspect 137, wherein the hIgG1-Fc recombinant fusion protein comprises an hIgG1-Fc-knob having an amino acid sequence of SEQ ID NOS: 8001-8004 or an amino acid sequence having greater than 60% sequence similarity to any one of SEQ ID NOS: 8001-8004.

Aspect 139. The compound of aspect 137, wherein the hIgG1-Fc recombinant fusion protein comprises an hIgG1-Fc-hole having an amino acid sequence of SEQ ID NOS: 8001-8004 or an amino acid sequence having greater than 60% sequence similarity to any one of SEQ ID NOS: 8001-8004.

Aspect 140. The compound of aspect 135, wherein the fusion protein comprises a hIgG1-Fc heterodimeric fusion protein.

Aspect 141. The compound of aspect 140, wherein the hIgG1-Fc heterodimeric fusion protein comprises an hIgG1-Fc-knob and an hIgG1-Fc-hole, wherein, the IL-2Rβγc ligand is bound to the hIgG1-Fc-knob and the IL-7Rαγc ligand is bound to the hIgG1-Fc-hole; or the IL-7Rαγc ligand is bound to the hIgG1-Fc-knob and the IL-2Rβγc ligand is bound to the hIgG1-Fc-hole.

Aspect 142 The compound of aspect 140, wherein the hIgG1-Fc heterodimeric fusion protein comprises an amino acid sequence selected from a combination of SEQ ID NOS: 8001-8004 or an amino acid sequence having greater than 60% sequence similarity to a combination of SEQ ID NOS: 8001-8004.

Aspect 143. The compound of aspect 135, wherein the fusion protein comprises a hIgG2-Fc recombinant fusion protein.

Aspect 144. The compound of aspect 135, wherein the fusion protein comprises a linear dual receptor binding ligand bound to the hIgG2-Fc fragment.

Aspect 145. The compound of aspect 135, wherein the fusion protein comprises a branched dual receptor binding ligand bound to the hIgG2-Fc fragment.

Aspect 146. The compound of aspect 145, wherein the hIgG2-Fc recombinant fusion protein comprises an amino acid sequence selected from any one of SEQ ID NOS: 8005-8007 or an amino acid sequence having greater than 60% sequence similarity to any one of SEQ ID NOS: 8005-8007.

Aspect 147. The compound of aspect 107, wherein the construct partner comprises an Fc-fragment.

Aspect 148. The compound of aspect 147, wherein the Fc-fragment is derived from IgG1, IgG2, or IgG4, or a mutant of any of the foregoing.

Aspect 149. The compound of aspect 148, wherein the ligand is bound to a C-terminus of the Fc-fragment.

Aspect 150. The compound of any one of aspects 147 to 149, wherein the ligand is bound to a N-terminus of the Fc-fragment.

Aspect 151. The compound of any one of aspects 147 to 150, wherein the IL-7Rαγc ligand is bound to the Fc-fragment though an Fc-fragment linker.

Aspect 152. The compound of aspect 151, wherein the Fc-fragment linker comprises a peptidyl Fc-fragment linker.

Aspect 153. The compound of aspect 152, wherein the peptidyl Fc-fragment linker comprises from 2 to 200 amino acids.

Aspect 154. The compound of any one of aspects 152 to 153, wherein the peptidyl Fc-fragment linker has a length from 5 Å to 200 Å.

Aspect 155. The compound of any one of aspects 152 to 154, wherein the peptidyl Fc-fragment linker comprises an amino acid sequence of any one of SEQ ID NOS: 9380-9386.

Aspect 156. The compound of aspect 107, wherein the construct partner is an immunoglobulin fragment.

Aspect 157. The compound of aspect 156, wherein the immunoglobulin fragment is selected from an IgG1 fragment, an IgG2 fragment, and an IgG4 fragment.

Aspect 158. The compound of any one of aspects 156 to 157, wherein the ligand is bound to a C-terminus of the immunoglobulin fragment.

Aspect 159. The compound of any one of aspects 156 to 158, wherein the ligand is bound to an N-terminus of the immunoglobulin fragment.

Aspect 160. The compound of any one of aspects 156 to 159, wherein the ligand is bound to the immunoglobulin fragment though an immunoglobulin linker.

Aspect 161. The compound of aspect 160, wherein the immunoglobulin linker comprises a peptidyl immunoglobulin linker.

Aspect 162. The compound of aspect 161, wherein the peptidyl immunoglobulin linker comprises from 2 to 200 amino acids.

Aspect 163. The compound of any one of aspects 161 to 162, wherein the peptidyl immunoglobulin linker has a length from 5 Å to 200 Å.

Aspect 164. The compound of any one of aspects 161 to 163, wherein the peptidyl immunoglobulin linker comprises an amino acid sequence of any one of SEQ ID NOS: 9380-9386.

Aspect 165. The compound of aspect 156, wherein at least one ligand is bound to an immunoglobulin heavy chain.

Aspect 166. The compound of any one of aspects 156 to 165, wherein at least one ligand is bound to an immunoglobulin light chain.

Aspect 167. The compound of aspect 107, wherein the construct partner comprises an antibody.

Aspect 168. The compound of aspect 167, wherein the antibody is directed to a tumor antigen.

Aspect 169. The compound of aspect 168, wherein the tumor antigen is selected from CEA and FAP.

Aspect 170. The compound of aspect 167, wherein the antibody is directed to a checkpoint inhibitor.

Aspect 171. The compound of aspect 170, wherein the checkpoint inhibitor is PD-1.

Aspect 172. The compound of aspect 171, wherein in the PD-1 antibody is selected from cemiplimab and pembrolizumab.

Aspect 173. The compound of aspect 167, wherein the antibody is directed to a cell-specific antigen.

Aspect 174. The compound of aspect 173, wherein the cell-specific antigen is selected from CD25, NK62D, and CD8.

Aspect 175. The compound of any one of aspects 167 to 174, wherein the antibody further comprises a cytokine.

Aspect 176. The compound of aspect 175, wherein the cytokine comprises an interleukin.

Aspect 177. The compound of aspect 106, wherein the compound comprises a cell-targeting moiety.

Aspect 178. The compound of aspect 177, wherein the cell-targeting moiety comprises a tumor-targeting moiety.

Aspect 179. The compound of aspect 177, wherein the cell-targeting moiety comprises an immune cell-targeting moiety.

Aspect 180. The compound of any one of aspects 106 to 179, wherein the compound further comprises a ubiquitin-like modifier.

Aspect 181. The compound of any one of aspects 106 to 180, wherein the compound further comprises a therapeutically effective moiety in addition to the dual receptor binding ligand.

Aspect 182. The compound of any one of aspects 106 to 181, wherein the compound is a full IL-2R agonist and a full IL-7R agonist.

Aspect 183. The compound of any one of aspects 106 to 181, wherein, the compound is a full IL-2R agonist and a partial IL-7R agonist; or the compound is a partial IL-2R agonist and a full IL-7R agonist.

Aspect 184. The compound of any one of aspects 106 to 181, wherein the compound is a partial IL-2R agonist and a partial IL-7R agonist.

Aspect 185. The compound of any one of aspects 106 to 181, wherein the compound is an IL-2R antagonist or an IL-7R antagonist.

Aspect 186. A pharmaceutical composition comprising the compound of any one of aspects 1-185.

Aspect 187. The pharmaceutical composition of aspect 186, further comprising a chemotherapeutic agent, an immunomodulator, a checkpoint inhibitor, a vaccine, or a combination of any of the foregoing.

Aspect 188. A method of treating cancer in a patient comprising administering to a patient in need of such treatment a therapeutically effective amount of the compound of any one of aspects 1-185.

Aspect 189. A method of treating an autoimmune disease in a patient comprising administering to a patient in need of such treatment a therapeutically effective amount of the compound of any one of aspects 1-185.

Aspect 190. A method of treating an inflammatory disease in a patient comprising administering to a patient in need of such treatment a therapeutically effective amount of the compound of any one of aspects 1-185.

Aspect 191 A method of expanding immune cells comprising contacting a population of immune cells ex vivo or in vivo with an effective amount of the compound of any one of aspects 1-185.

Aspect 192. A method of expanding immune cells comprising contacting a population of immune cells ex vivo or in vivo with an effective amount of the compound of any one of aspects 1-185.

Aspect 193. A method of boosting a vaccine comprising administering to a patient a vaccine and a therapeutically effective amount of the compound of any one of aspects 1-185.

Aspect 194. A method of modifying the immune response comprising administering to a patient an effective amount of the compound of any one of aspects 1-185.

Aspect 195. A nucleic acid encoding for the compound of any one of aspects 1-185.

Aspect 196. A nucleic acid encoding for the IL-2Rβγc ligand, wherein the IL-2Rβγc ligand comprises an amino acid sequence selected from any one of SEQ ID NOS: 4001-4007, a truncated amino acid sequence of any one of SEQ ID NOS: 4001-4007, or an amino acid sequence having greater than 60% amino acid sequence similarity to any one of SEQ ID NOS: 4001-4007.

Aspect 197. A nucleic acid encoding for the IL-2Rβγc ligand, wherein the IL-2Rβγc ligand comprises an amino acid sequence of SEQ ID NO: 4001, a truncated amino acid sequence of SEQ ID NO: 4001, or an amino acid sequence having greater than 60% amino acid sequence similarity to SEQ ID NO: 4001.

Aspect 198. A nucleic acid encoding for an IL-7Rαγc ligand, wherein the IL-7Rαγc ligand comprises an amino acid sequence selected from any one of SEQ ID NOS: 4021-4028, a truncated amino acid sequence of any one of SEQ ID NOS: 4021-4028, or an amino acid sequence having greater than 60% amino acid sequence similarity to any one of SEQ ID NOS: 4021-4028.

Aspect 199. A nucleic acid encoding for an IL-7Rαγc ligand, wherein the IL-7Rαγc ligand comprises an amino acid sequence of SEQ ID NO: 4021, a truncated amino acid sequence of SEQ ID NO: 4021, or an amino acid sequence having greater than 60% amino acid sequence similarity to of SEQ ID NO: 4021.

Aspect 200. A nucleic acid encoding for a linear dual receptor binding ligand of any one of aspects 1-185.

Aspect 201. A nucleic acid encoding for a linear dual receptor binding ligand comprising an amino acid sequence of any one of SEQ ID NOS: 4041-4058, a truncated amino acid sequence of any one of SEQ ID NOS: 4041-4058, an amino acid sequence having greater than 60% amino acid sequence similarity to any one of SEQ ID NOS: 4041-4058, or a combination of any of the foregoing.

Aspect 202. A nucleic acid encoding for a linear dual receptor binding ligand comprising an amino acid sequence of SEQ ID NO: 4041, a truncated amino acid sequence of SEQ ID NO: 4041, or an amino acid sequence having greater than 60% amino acid sequence similarity to SEQ ID NO: 4041, or a combination of any of the foregoing.

Aspect 203. A nucleic acid encoding for the compound of any one of aspects 1-185.

Aspect 204. The nucleic acid of aspect 203, wherein the ligand comprises: an IL-2Rβ ligand comprising the amino acid sequence of SEQ ID NO: 395, a truncated amino acid sequence of SEQ ID NO: 395, or an amino acid sequence having greater than 60% amino acid sequence similarity to SEQ ID NO: 395; an IL-7Rα ligand comprising the amino acid sequence of SEQ ID NO: 2407, a truncated amino acid sequence of SEQ ID NO: 2407, or an amino acid sequence having greater than 60% amino acid sequence similarity to SEQ ID NO: 2407; and/or an Rγc ligand comprising the amino acid sequence of SEQ ID NO: 1204, a truncated amino acid sequence of SEQ ID NO: 1204, or an amino acid sequence having greater than 60% amino acid sequence similarity to SEQ ID NO: 1204.

Aspect 1A. A dual receptor binding compound, wherein the dual receptor binding compound comprises: an IL-2Rβ ligand, wherein IL-2Rβ ligand comprises an amino acid sequence of any one of Formula (1)-(1c), (2)-2c), (3)-(3b), (4), (5)-(5g), (6)-(6e), (7)-(7d), (8)-(8e), or (9)-(9f); a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing; an Rγc ligand, wherein Rac ligand comprises an amino acid sequence of any one of Formula (11)-(11c), (12)-(12c), (13)-(13b), (14)-(14c), (15)-(15a), (16)-(16d), or (17)-(17e); a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing; and an IL-7Rα ligand, wherein IL-7Rα ligand comprises an amino acid sequence of any one of Formula (21)-(21b), (22)-(22d), (23)-(23d), (24)-(24e), (25)-(25c), (26)-(26e), (27)-(27e), (28)-28e), or (29)-29c); a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

Aspect 2A. A dual receptor binding compound, wherein the dual receptor binding compound comprises: an IL-2Rβ ligand, wherein the IL-2Rβ ligand comprises an amino acid sequence of any one of SEQ ID NOS: 1-572, 574-655, 661-891, 900-926, 930-937, or 9301-9315, a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing; an Rγc ligand, wherein Rac ligand comprises an amino acid sequence of any one of SEQ ID NOS: 1001-1215, 1601-1613, or 9340-9353, a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing; and an IL-7Rα ligand, wherein IL-7Rα ligand comprises an amino acid sequence of any one of SEQ ID NOS: 2001-2410, 2601, 2602, or 9320-9332; a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

Aspect 3A. The dual receptor binding compound of any one of aspects 1A and 2A, wherein, the IL-2Rβ ligand comprises an amino acid sequence of SEQ ID NO: 395; a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing; the Rγc ligand comprises an amino acid sequence of SEQ ID NO: 1204; a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing; and/or the IL-7Rα ligand comprises an amino acid sequence of SEQ ID NO: 2407; a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

Aspect 4A. The dual receptor binding compound of any one of aspects 1A to 3A, wherein, the IL-2Rβ ligand binds to the hIL-2Rβ subunit with and IC50 less than 100 μM as determined using phage ELISA competition assays the Rγc ligand binds to the hRγc subunit with and IC50 less than 100 μM as determined using phage ELISA competition assays; and the IL-7Rα ligand binds to the hIL-7Rα subunit with and IC50 less than 100 μM as determined using phage ELISA competition assays.

Aspect 5A. The dual receptor binding compound of any one of aspects 1A to 4A, wherein, the IL-2Rβ ligand binds to a specific binding site of the hIL-2Rβ subunit with and IC50 less than 100 μM as determined using phage ELISA competition assays; the Rγc ligand binds to a specific binding site of the hRγc subunit with and IC50 less than 100 μM as determined using phage ELISA competition assays; and the IL-7Rα ligand binds to a specific binding site of the hIL-7Rα subunit with and IC50 less than 100 μM as determined using phage ELISA competition assays.

Aspect 6A. The dual receptor binding compound of any one of aspects 1A to 5A, wherein the dual receptor binding compound comprises a linear dual receptor binding ligand.

Aspect 7A. The dual receptor binding compound of aspect 6, wherein the linear dual receptor binding ligand has the structure of Formula (104a)-(104f).

Aspect 8A. The dual receptor binding compound of any one of aspects 1A to 5A, wherein the dual receptor binding compound comprises a branched dual receptor binding ligand.

Aspect 9A. The dual receptor binding compound of aspect 8A, wherein the branched dual receptor binding ligand has the structure of Formula (105a)-(105d), Formula (106a)-(106b), or Formula (107).

Aspect 10A. The dual receptor binding compound of any one of aspects 1A to 5A, wherein the dual receptor binding compound comprises: an IL-2Rγc ligand, wherein the IL-2Rβγc ligand comprises the IL-2Rβ ligand and the Rγc ligand; and an IL-7Rαγc ligand, wherein the IL-7Rαγc ligand comprises the IL-7Rα ligand and the Rγc ligand.

Aspect 11A. The dual receptor binding compound of aspect 10A, wherein, the IL-2Rβγc ligand has the structure of Formula (101); and the IL-7Rαγc ligand has the structure of Formula (102).

Aspect 12A. The dual receptor binding compound of any one of aspects 10A to 11A, wherein, the IL-2Rβγc ligand comprises an amino acid sequence of any one of SEQ ID NOS: 4001-4007, 4070-4085, 4090-4094, or 4095-4099; a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing; and the IL-7Rαγc ligand comprises an amino acid sequence of any one of SEQ ID NOS: 4021-4028. a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

Aspect 13A. The dual receptor binding compound of any one of aspects 10A to 12A, wherein, the IL-2Rβγc ligand binds to hIL-2R with an IC50 less than 100 µM as determined using phage ELISA competition assays; and the IL-7Rαγc ligand binds to hIL-7R with an IC50 less than 100 µM as determined using phage ELISA competition assays.

Aspect 14A. The dual receptor binding compound of any one of aspects 10A to 13A, wherein, the IL-2Rβγc ligand exhibits an $EC_{50}$ for STAT5 phosphorylation in TF-1β cells and/or NK-92 cells of less than 100 µM; and the IL-7Rαγc ligand exhibits an $EC_{50}$ for STAT5 phosphorylation in TF-1β cells and/or NK-92 cells of less than 100 µM.

Aspect 15A. The dual receptor binding compound of any one of aspects 10A to 14A, wherein, the IL-2Rβγc ligand is a full IL-2R agonist, a partial IL-2R agonist, or an IL-2R antagonist; and the IL-7Rαγc ligand is a full IL-7R agonist, a partial IL-7R agonist, or an IL-7R antagonist.

Aspect 16A. The dual receptor binding compound of any one of aspects 10A to 15A, wherein the dual receptor binding compound comprises a construct partner.

Aspect 17A. The dual receptor binding compound of aspect 16A, wherein the dual receptor binding compound comprises an IL-2Rβγc ligand and an IL-7Rαγc ligand; and each of the IL-2Rβγc ligand and the IL-7Rαγc ligand is independently bound to the construct partner through a construct linker.

Aspect 18A. The dual receptor binding compound of aspect 17A, wherein the construct linker comprises a peptidyl ligand linker.

Aspect 19A. The dual receptor binding compound of aspect 17A, wherein the construct linker comprises a chemical ligand linker.

Aspect 20A. The dual receptor binding compound of aspect 17A, wherein the construct linker comprises $(G)_n$ (SEQ ID NO: 9380), $(GS)_n$ (SEQ ID NO: 9381), $(GGS)_n$ (SEQ ID NO: 9382). $(GGGS)_n$ (SEQ ID NO: 9383), or $(GGGGS)_n$ (SEQ ID NO: 9384), wherein n is an integer from 1 to 20.

Aspect 21A. The dual receptor binding compound of aspect 16A, wherein the dual receptor binding compound comprises an amino acid sequence of any one of SEQ ID NOS: 8001-8007, 8012-8052, 8061-8082, 8101, 8102, and PEG-1 to PEG-7, a truncated amino acid sequence of any of the foregoing, a substituted amino acid sequence of any of the foregoing, any of the foregoing amino acid sequences having flanking amino acids, and an amino acid sequence having greater than 60% sequence similarity to any of the foregoing.

Aspect 22A. The dual receptor binding compound of any one of aspects 16A to 21A, wherein the dual receptor binding compound binds to hIL-2R with an IC50 less than 100 µM and binds to hIL-7R with an IC50 less than 100 µM.

Aspect 23A. The dual receptor binding compound of any one of aspects 16A to 22A, wherein the dual receptor binding compound exhibits an $EC_{50}$ for STAT5 phosphorylation in TF-1β cells and/or NK-92 cells of less than 100 µM.

Aspect 24A. The dual receptor binding compound of any one of aspects 1A to 23A, wherein the construct partner is selected from a polymer, a polypeptide, an Fc-fragment, an immunoglobulin fragment, an antibody.

Aspect 25A. The dual receptor binding compound of any one of aspects 1A to 24A, wherein the construct partner comprises a viral surface antigen or a virus-like particle.

Aspect 26A. The dual receptor binding compound of any one of aspects 1A to 25A, wherein the construct partner comprises a cytokine.

Aspect 27A. The dual receptor binding compound of any one of aspects 1A to 26A, wherein the compound comprises a recombinant fusion protein.

Aspect 28A. The dual receptor binding compound of aspect 27A, wherein the fusion protein is selected from a hIgG-Fc recombinant fusion protein and a hIgG1-Fc recombinant fusion protein.

Aspect 29A. The dual receptor binding compound of any one of aspects 1A to 28A, wherein the construct partner comprises an antibody and the antibody is directed to a tumor antigen.

Aspect 30A. The dual receptor binding compound of any one of aspects 16A to 29A, wherein the construct partner comprises a cell-targeting moiety.

Aspect 31A. The dual receptor binding compound of aspect 30A, wherein cell-targeting moiety comprises a tumor-targeting moiety, an immune cell-targeting moiety, or a combination thereof.

Aspect 32A. A pharmaceutical composition comprising a dual receptor binding compound of any one of aspects 1A to 31A.

Aspect 33A. The pharmaceutical composition of aspect 32A, further comprising a chemotherapeutic agent, an immunomodulator, a checkpoint inhibitor, a vaccine, or a combination of any of the foregoing.

Aspect 34A. A method of treating a disease in a patient comprising administering to a patient in need of such treatment a therapeutically effective amount of the dual receptor binding compound of any one of aspects 1A to 31A, or the pharmaceutical composition of any one of aspects 32A to 33A.

Aspect 35A. The method of aspect 34A, wherein the disease is selected from cancer, an autoimmune disease, an inflammatory disease, an infectious disease, and a viral disease.

Aspect 36. A method of expanding immune cells comprising contacting a population of immune cells ex vivo or in vivo with an effective amount of the dual receptor binding compound of any one of aspects 1A to 31A.

Aspect 37. A method of expanding immune cells comprising contacting a population of immune cells ex vivo or in vivo with an effective amount of the dual receptor binding compound of any one of aspects 1A to 31A.

Aspect 38A. A method of boosting a vaccine comprising administering to a patient a vaccine and a therapeutically effective amount of the dual receptor binding compound of any one of aspects 1A to 31A, or the pharmaceutical composition of any one of aspects 32A to 33A.

Aspect 39A. A method of modifying the immune response comprising administering to a patient an effective amount of the dual receptor binding compound of any one of aspects 1A to 31A, or the pharmaceutical composition of any one of aspects 32A to 33A.

Aspect 40A. A nucleic acid encoding for the dual receptor binding compound of any one of aspects 1A to 31A.

Aspect 41A. A nucleic acid encoding a polypeptide comprising the IL-2Rβγc ligand of any one of aspects 10A to 15A.

Aspect 42A. A nucleic acid encoding a polypeptide comprising the IL-7Rαγc ligand of any one of aspects 10A to 15A.

EXAMPLES

The following examples describe in detail methods of synthesizing IL-2Rβγc ligands, IL-7Rαγc ligands, dual receptor IL-2Rβγc/IL-7Rαγc ligands and dual binding compounds provided by the present disclosure and the properties of the ligands and dual binding compounds. The following examples also describe in detail methods for determining properties of the IL-2Rβγc ligands, IL-7Rαγc, dual receptor binding ligands and dual receptor binding compounds provided by the present disclosure. It will be apparent to those skilled in the art that many modifications, both to materials and methods, may be practiced without departing from the scope of the invention.

In the examples, the IL-2Rβ subunit refers to the human IL-2Rβ (CD122 protein, Fc Tag) (27-239), Accession No. NP_000869.1 and was obtained from ACRObiosystems, Inc., product number ILB-H5253.

In the examples, the IL-7Rα subunit refers to the human IL-7Rα (CD127 protein, Fc Tag) (21-236), Accession No. P16871-1 and was obtained from ACRObiosystems, Inc., product number ILB-H5258.

In the examples, the Rγc subunit refers to the human Rγc (CD132 protein, Fc Tag) (23-254), Accession No. AAH14972 and was obtained from ACRObiosystems, Inc., product number ILG-H5256.

In the examples, the cyano-IL-2Rβ subunit refers to the cynomolgus monkey IL-2Rβ subunit, Accession No. NP_000869.1 and was obtained from Sino Biological Inc., product number 90328-C02H.

In the examples, the IL-2Rγc subunit refers to the cynomolgus monkey Rγc subunit, Accession No. XP_005503949.1.

In the examples the cyano IL-7Rα subunit refers to the cynomolgus monkey IL-7Rα subunit, Accession No. NP_001271837.1 (ECD Met1-Pro235) and was obtained from Sino Biological Inc., product number 90332-C08H.

Example 1

Synthesis of IL-2Rβγc Ligands Using Click Chemistry

The peptide sequences of an IL-2Rβ ligand and an Rγc ligand were synthesized separately using standard solid phase synthesis conditions and Fmoc-protected amino acids as described in Example 1.

Rink amide-MBHA resin (1 g, 1.5 mmole/g, Anaspec) was washed with DMF (2×), and then allowed to stand in 50 mL DMF for 10 min. Separate portions of the swollen resin were treated with either an activated solution of Fmoc-propargyl glycine (IL-2Rβ ligand) or 2-(Fmoc-NH)-5-azido-pentanoic acid (Rγc ligand) prepared from 5 eq. of amino acid and 5 eq. of HATU dissolved at 0.5M in DMF, followed by the addition of 10 eq. of DIEA, and the mixture was gently stirred for 30 min at 25° C. The resin was washed (DMF, THF, DCM, and MeOH) and dried to yield the Fmoc-protected resin. Fmoc groups were then removed by gently shaking the resin in 30% piperidine in DMF for 20 min, followed by washing (DMF, THF, DCM, and MeOH), and drying. The resin was then subjected to repeated cycles of Fmoc-amino acid couplings with HATU activation and Fmoc removal with piperidine to provide a desired IL-2Rβ ligand amino acid sequence and a desired Rγc ligand amino acid sequence. Standard 95% TFA-labile amino acid side-chain protecting groups were used for all residues. After Fmoc removal from the final amino acid of each ligand sequence, the terminal amine groups were acylated with acetic anhydride (10 eq.) and DIEA (20 eq.) in DMF for 20 min.

Each completed ligand was cleaved from the resin by suspension in a solution of TFA (95%), water (2.5%), and triisopropylsilane (2.5%) for 3 h at 25° C. The TFA solution was cooled to 5° C. and poured into Et$_2$O to precipitate the peptide. Filtration and drying under reduced pressure gave the desired ligands. Purification via preparative HPLC with a C18 column afforded the pure peptides with the two thiol groups in a reduced state. The ligands were separately dissolved in 20% DMSO/water (1 mg dry weight peptide/mL), allowed to stand at 25° C. for 36 h., and then purified by reverse phase HPLC to provide the IL-2Rβ and Rγc ligands with the two cysteines linked via an intramolecular disulfide bridge.

Two-tenths (0.2) mL of a 2.0 mM solution of purified alkyne-containing IL-2Rβ ligand was prepared by dissolving the ligand in 1:1 H$_2$O/tBuOH. Similarly, 0.2 mL of a 2.4 mM solution of the purified azide-containing ligand was prepared using the same solvent. The two ligand solutions along with 0.1 mL of 100 mM CuSO$_4$ in H$_2$O, 0.1 mL of 250 mM of a Cu(I) chelating agent such as DIEPA, pyridine, or THPTA (tris(3-hydroxypropyltriazolylmethyl)amine), in 3:1 DMSO/tBuOH, 0.1 mL of 0.5M ascorbic acid in H$_2$O, and 0.3 mL of 3:2 tBuOH/H$_2$O were combined, and the reaction allowed to proceed at 45° C. under anaerobic conditions. Reaction progress was monitored frequently by LC/MS, and additional azide-containing ligand and CuSO$_4$ were added to drive the reaction to completion. After the maximal amount of alkyne was consumed (approx. 3 h), the reaction was quenched by adding approx. 8 mL of 1:1 H$_2$O/ACN, and the peptide dimer was purified (95%) using a preparative-scale C18 HPLC column.

The structure of IL-2Rβ ligands and Rγc ligands used in the experimental examples is provided in Tables 7 and 8, and in FIGS. 19A-19C.

TABLE 7

IL-2Rβ Ligands.

SEQ ID NO: 154\417
Y D C R I A Q V G E L C D L

SEQ ID NO: 378
V Q Y K K C W M A Q L G D L C E L D P S

SEQ ID NO: 403
Y P C W M A Q L G E L C D L

SEQ ID NO: 418
Y P C H M A Q L G E L C D L W S W G D I

SEQ ID NO: 469
D V L G D R W Y P C W I A K L G E L C D L D

SEQ ID NO: 475
F Y P C W T A L L G E L C D L E P G P P A M

SEQ ID NO: 500
R Q R W Y P C W M A R L G E L C D L D E P T

SEQ ID NO: 532
W R R W Y P C W V A Q V G E L C D L E I E A

SEQ ID NO: 395
W Y P C W M A Q L G E L C D L D

SEQ ID NO: 536
W G T T W R W Y P C W M A Q L G E L C D L E

SEQ ID NO: 538
W Y P C W I A Q L G E L C D L D

TABLE 7-continued

IL-2Rβ Ligands.

SEQ ID NO: 539
W Y P C W L A K L G E L C D L D

SEQ ID NO: 552
W Y P C W M A Q L G D L C D L E K P V T E R

TABLE 8

Rγc Ligands.

SEQ ID NO: 1034
D C S M W E G V E L C W

SEQ ID NO: 1056
V M C E R W Q G V E L C W L

SEQ ID NO: 1192
R T G V E C Q D W H G V E L C W P V W E

SEQ ID NO: 1193
R T E V E C E D W E G V E L C W L

SEQ ID NO: 1200
T W N M S E L E C Q D W N G V E I C W H

SEQ ID NO: 1204
V V C Q D W E G V E L C W Q

SEQ ID NO: 1213
V G I E C E E W A G V E L C W L

SEQ ID NO: 1214
W S K K A E V V C E E W G G V E F C W I

Example 2

STAT5 Phosphorylation in TF-1β Cells with IL-2Rβγc Ligands Having Different Ligands/Orientations/Linkers IL-2Rβγc ligands were evaluated for induction of STAT5 phosphorylation in TF-1β cells. TF-1 cells were derived from the growth factor-dependent human erythroleukemia cell line TF-1 (ATCC No. CRL-2003), which naturally expresses Rγc but not IL-2Rβ. The cells were engineered to be IL-2 responsive by transfection with human full-length IL-2Rβ. A cell line expressing higher levels of IL-2Rβ was selected by growth in IL-2, and both IL-2Rβ and IL-2Rγc subunit expression levels were verified by qPCR and FACS analysis.

To test compounds for induction of STAT5 phosphorylation, TF-1β cells were starved overnight at $5\times10^5$ cells/mL in starvation medium (RPMI 1640+2.5 μg/L glucose+5% FBS+2 mM L-glutamine+1 mM NaPyr+10 mM HEPES with no GM-CSF or rhIL-2 supplement) in T75 flasks. The following day, cells were plated in 96-well V-bottom plates at $2\times10^5$ cells/well. Three-fold serial dilutions of IL-2Rβγc ligands or IL-2 in starvation media were added to the cells and incubated for 30 min at 37° C. Cell extracts were prepared by adding a mixture of 10× Cell Lysis Buffer (Cell Signaling Technology No. 9803) and 1×HALT Phosphatase and Protease Inhibitor Cocktail (Thermo Fisher No. 78442) directly to the wells. The plates were agitated at 25° C. for 5 min to prepare cell extracts for immediate use or stored at −80° C. Detection of pSTAT5 was performed using a PathScan® Phospho-Stat5 (Tyr694) Sandwich ELISA Kit (Cell Signaling Technology No. 7113). Cell extracts were added to microwells that were pre-coated with a mouse anti-phospho-STAT5 antibody and incubated overnight at 4° C. Wells were then washed with PBS and bound phospho-STAT5 (Tyr694) was detected by adding a rabbit anti-STAT5 detection antibody and incubating for 1 h at 37° C. The wells were washed with PBS and an anti-rabbit IgG HRP-linked antibody was added to each well. After a final wash, TMB substrate solution was added to measure the amount of HRP in each well. Absorbance at 450 nm was read in a microplate reader. The signal that was produced is proportional to the quantity of phosphorylated STAT5 in each cell extract.

Figure 2:
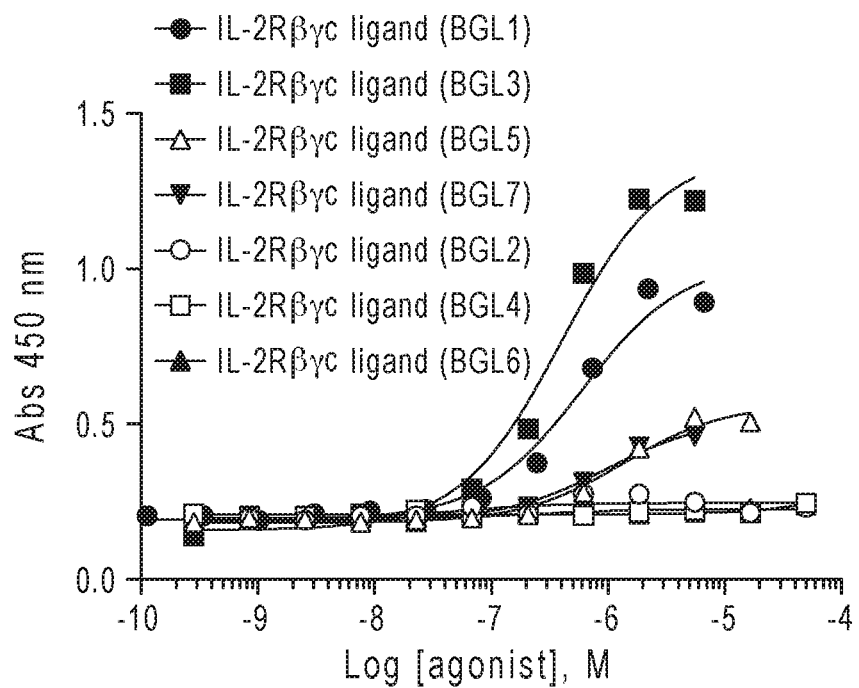
FIG. 2 shows STAT5 phosphorylation in TF-1β cells exposed to various IL-2Rβγc ligands having different IL-2Rβ and Rγc ligands with different C/N orientations and different ligand linker lengths.

The results are presented in FIG. 2.

The structures of the IL-2Rβγc ligands evaluated in FIG. 2 are provided in FIGS. 19A-19C.

Example 3

STAT5 Phosphorylation in NK-92 Cells with IL-2Rβγc Ligands Having Different IL-2R and Rγc Ligands with a C/C Orientation and with the Same Ligand Linker IL-2Rβγc ligands were evaluated for induction of STAT5 phosphorylation in NK-92 cells, a human cell line that expresses all three IL-2 receptor subunits, and which is responsive to IL-2Rβγc-biased variants as well as to wild type IL-2. To test compounds for induction of STAT5 phosphorylation, NK-92 cells were starved overnight in starvation medium (RPMI 1640+20% FBS+2 mM L-glutamine+1 mM NaPyr+10 mM HEPES+0.1 mM BME with no rhIL-2 supplement) at 37° C. in T75 flasks. The following day, the NK-92 cells were plated in 96-well V-bottom plates at $2\times10^5$ cells/well. Three-fold serial dilutions of test compounds or IL-2 in starvation media were added to the cells and incubated for 30 min at 37° C.

Cell extracts were prepared and the amount of phosphorylated STAT5 was measured using a PathScan® Phospho-Stat5 (Tyr694) Sandwich ELISA Kit as described in Example 3.

Figure 3:
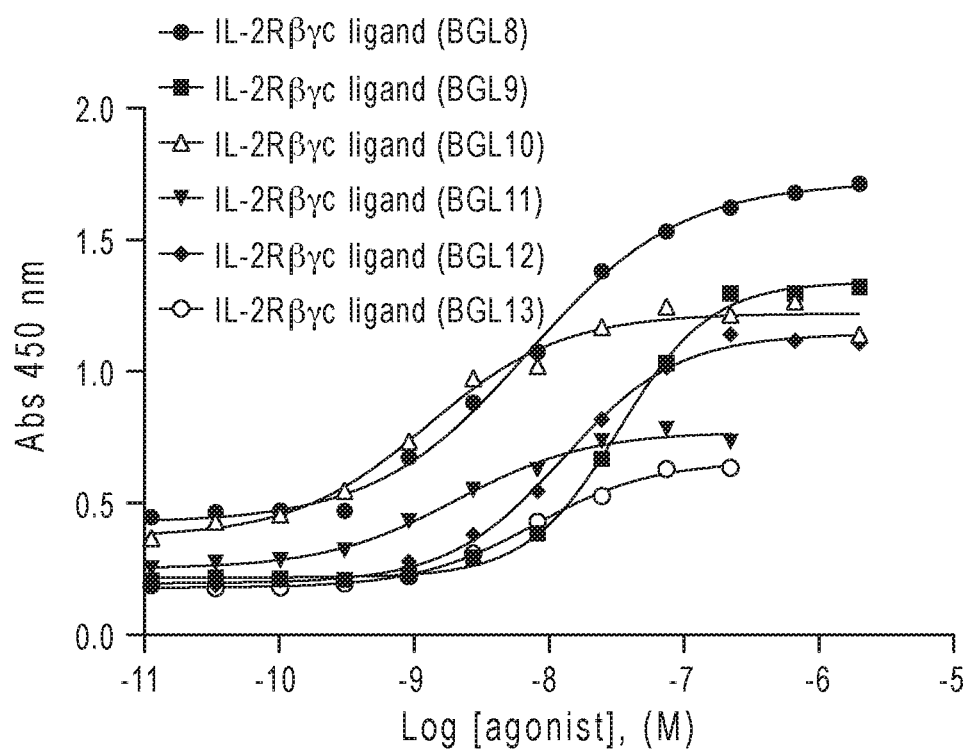
FIG. 3 shows STAT5 phosphorylation in NK-92 cells exposed to various IL-2Rβγc ligands having different IL-2Rβ and Rγc ligands with a C/C orientation and with the same IL-2Rβγc ligand linker.

The results are presented in FIG. 3.

The structures of the IL-2Rβγc ligands evaluated in FIG. 3 are provided in FIGS. 19A-19C.

Example 4

STAT5 Phosphorylation in NK-92 Cells with IL-2Rβγc Ligands Having Different Orientations The agonist activity of IL-2Rβγc ligands comprising the same IL-2Rβ and Rγc ligands bound to the same ligand linker but with different N/C orientations was evaluated using a STAT5 phosphorylation assay in NK-92 cells.

IL-2Rβγc ligands were incubated with NK-92 cells and STAT5 phosphorylation measured as a function of concentration using the methods described in Example 3.

Figure 4:
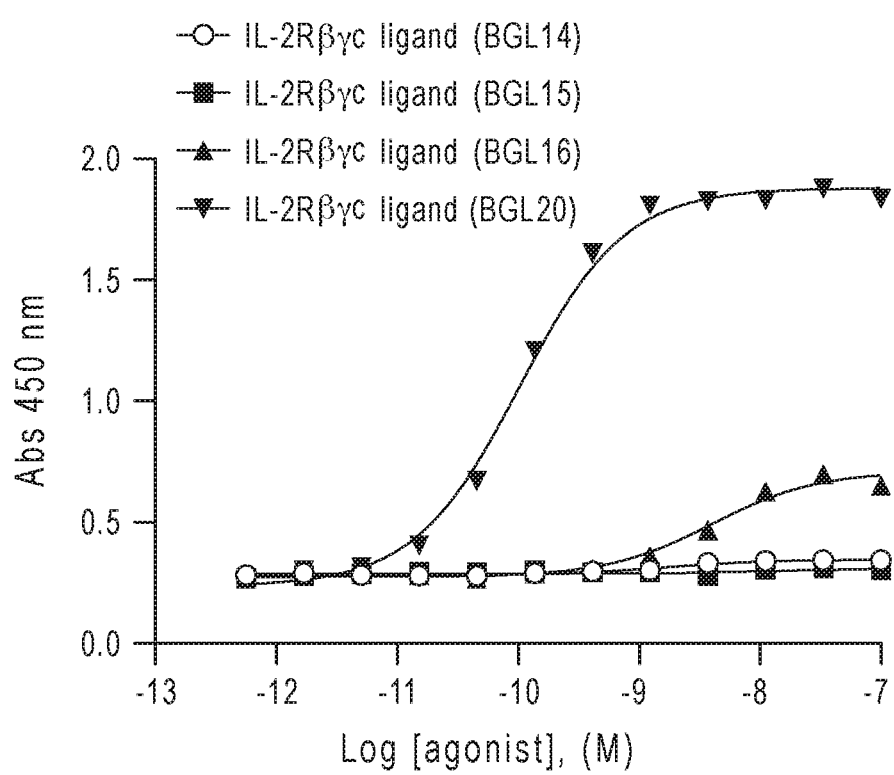
FIG. 4 shows STAT5 phosphorylation in NK-92 cells exposed to IL-2Rβγc ligands having an IL-2Rβ ligand having SEQ ID NO: 9301 (BL4) and an Rγc ligand having SEQ ID NO: 9340 (GL2), with different C/N orientations.

The results are presented in FIG. 4.

The structures of the IL-2Rβγc ligands evaluated in FIG. 4 are provided in FIGS. 19A-19C.

Example 5

STAT5 Phosphorylation in TF-1β Cells with IL-2Rβγc Ligands with Different Ligands The agonist activity of IL-2Rβγc ligands comprising different IL-2R and Rγc ligands bound to the same synthetic ligand linker and with the same N/C orientation was evaluated using a STAT5 phosphorylation assay in TF-1β cells.

Compounds were incubated with TF-1β cells and STAT5 phosphorylation was measured as a function of concentration using the methods described in Example 3.

Figure 5A:
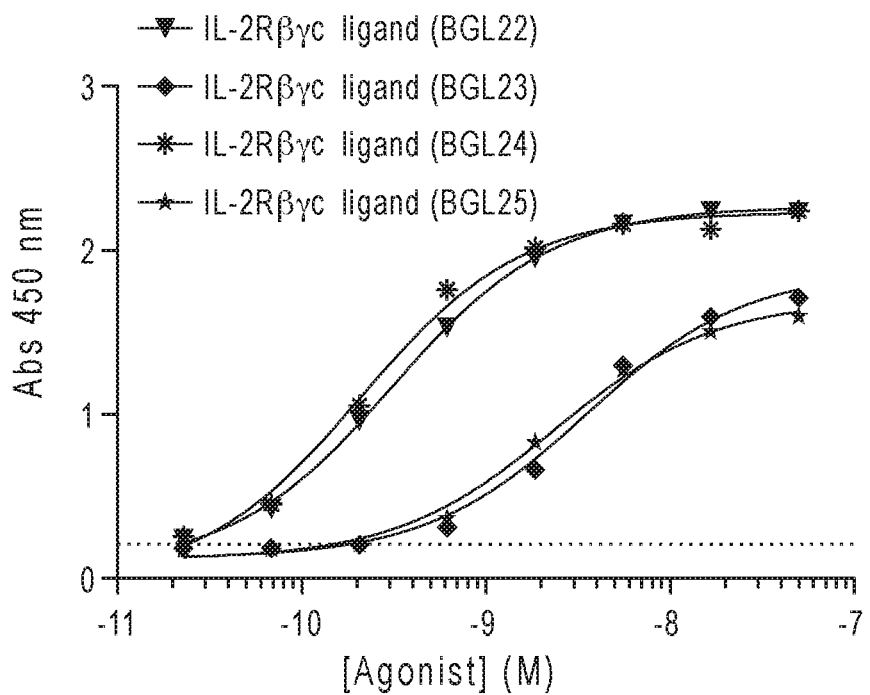
FIGS. 5A and 5B show STAT5 phosphorylation in TF-1β cells exposed to IL-2Rβγc ligands having different IL-2Rβ and Rγc ligands with a C/N orientation and with the same IL-2Rβγc ligand linker.
Figure 5B:
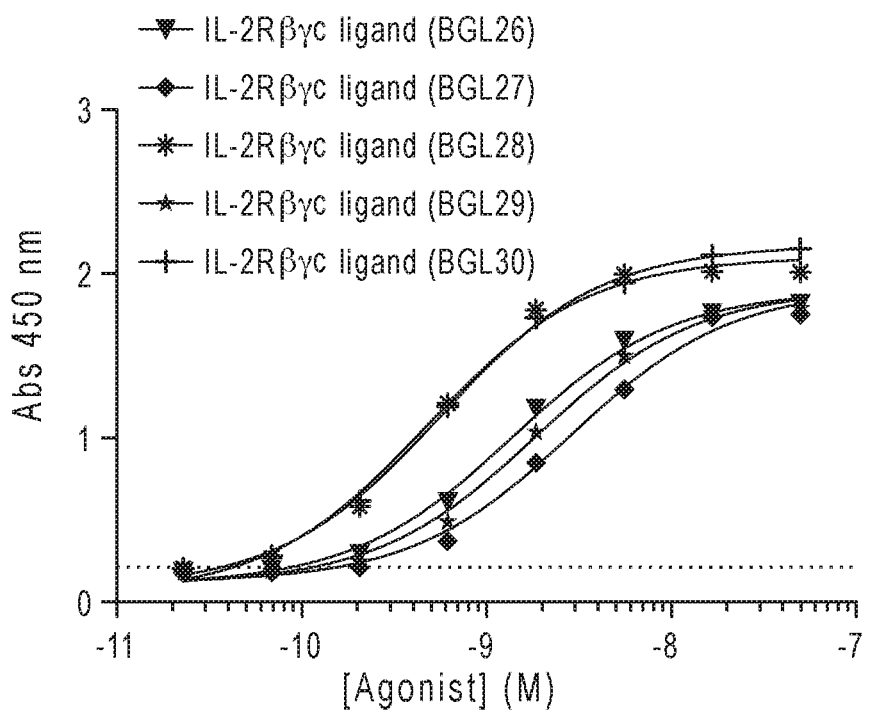

The results are presented in FIGS. 5A and 5B.

The structures of the IL-2Rβγc ligands evaluated in FIGS. 5A and 5B are provided in FIGS. 19A-19C.

Example 6

STAT5 Phosphorylation in NK-92 Cells with IL-2Rβγc Ligands with Different Linkers The agonist activity of IL-2Rβγc ligands comprising the same IL-2R and Rγc ligands bound to a synthetic IL-2Rβγc ligand linker (IL-2Rβγc ligand (BGL20)) or to a peptidyl IL-2Rβγc ligand linker (IL-2Rβγc ligand (BGL21)) and with the same N/C orientation was evaluated using a STAT5 phosphorylation assay in NK-92 cells.

IL-2Rβγc ligands were incubated with NK-92 cells and STAT5 phosphorylation was measured as a function of concentration using the methods described in Example 3.

Figure 6:
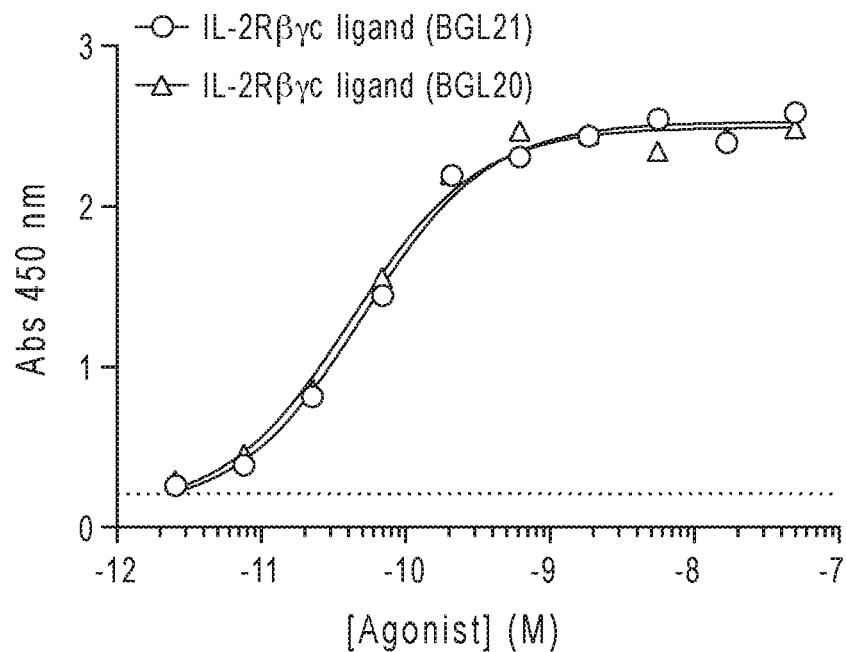
FIG. 6 shows STAT5 phosphorylation in NK-92 cells exposed to IL-2Rβγc ligands having an IL-2Rβ ligand having SEQ ID NO: 9301 (BL4) and an Rγc ligand of SEQ ID NO: 9340 (GL2), having either a -GGGGS- (G4S) (SEQ ID NO: 9395) amino acid linker (IL-2Rβγc ligand (BGL21)) or a click chemistry-derived triazole-containing linker (IL-2Rβγc ligand (BGL20)).

The results are presented in FIG. 6.

The structures of the IL-2Rβγc ligands evaluated in FIG. 6 are provided in FIGS. 19A-19C.

Example 7

STAT5, AKT and ERK1/2 Phosphorylation in NK-92 Cells with IL-2 and an IL-2Rβγc Ligand The agonist activity of IL-2 and an IL-2Rβγc ligand (BGL21) was evaluated using STAT5 phosphorylation, AKT phosphorylation, and ERK1/2 phosphorylation assays in NK-92 cells.

Compounds were incubated with NK-92 cells and STAT5 phosphorylation was measured as a function of concentration using the methods described in Example 3. Detection of phosphorylated AKT was performed using the PathScan® Phospho-AKT (Thr308) Sandwich ELISA Kit (Cell Signaling Technology No. 7252). Detection of phosphorylated ERK1/2 was performed using PathScan® Phospho-p44/42 MAPK (Thr202/Tyr204) Sandwich ELISA Kit (Cell Signaling Technology No. 7177).

Figure 7A:
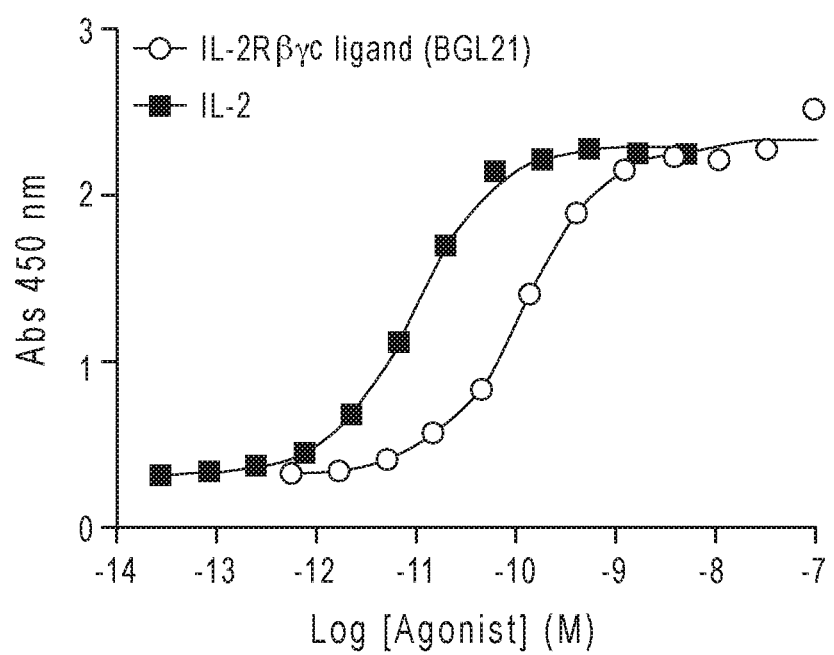
FIGS. 7A-7C show STAT5 phosphorylation in NK-92 cells, AKT phosphorylation in NK-92 cells, and ERK1/2 phosphorylation in NK-92 cells, respectively, following exposure to either IL-2Rβγc ligand (BGL21) or to IL-2.
Figure 7B:
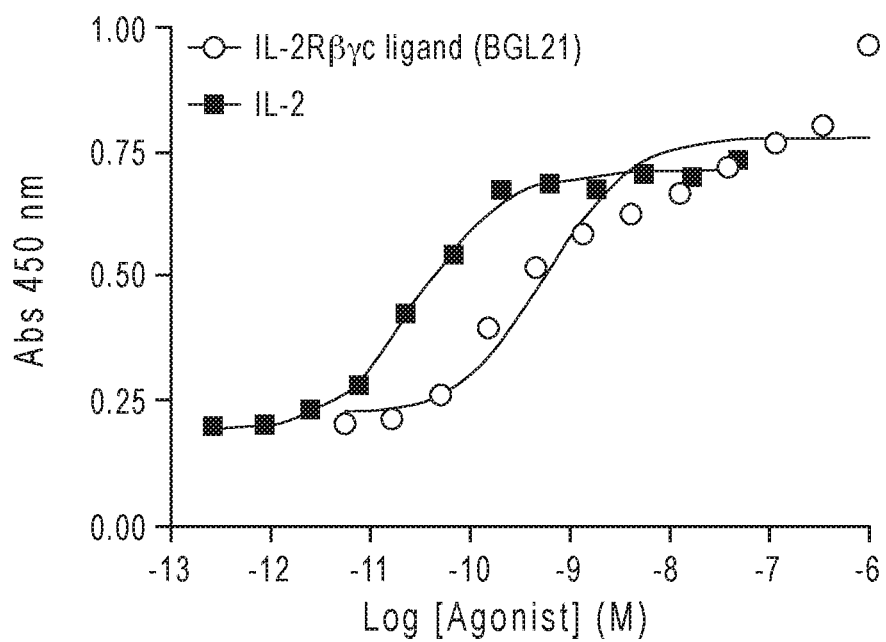
Figure 7C:
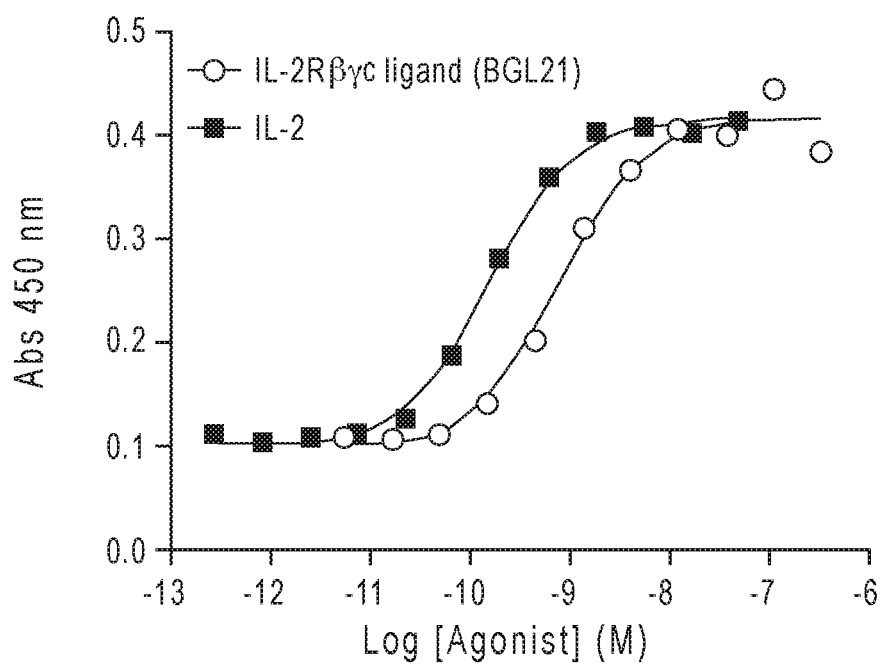

The results are presented in FIG. 7A for STAT5 phosphorylation, in FIG. 7B for AKT phosphorylation, and in FIG. 7C for ERK1/2 phosphorylation.

The structures of the IL-2Rβγc ligands evaluated in FIGS. 7A-7C are provided in FIGS. 19A-19C.

Example 8

Proliferation of NK-92 with IL-2 and an IL-2R 3γc Ligand

NK-92 cells were plated in starvation media (minus growth factors) and incubated with serial dilutions of IL-2Rβγc ligand (BGL21) or IL-2 at 37° C. for 48 h. The number of viable cells present in each well was quantified by measuring ATP levels, which is an indicator of metabolically active cells, using a CellTiter-Glo® Assay Kit (Promega #G7571). An equal volume of CellTiter-Glo® reagent was added to each well and incubated at 25° C. for 10 min. Luminescence signals were measured using a Wallac Victor 1420 plate reader. Values (in relative light units (RLU)) were plotted as a function of the concentration of the test compounds.

Figure 8A:
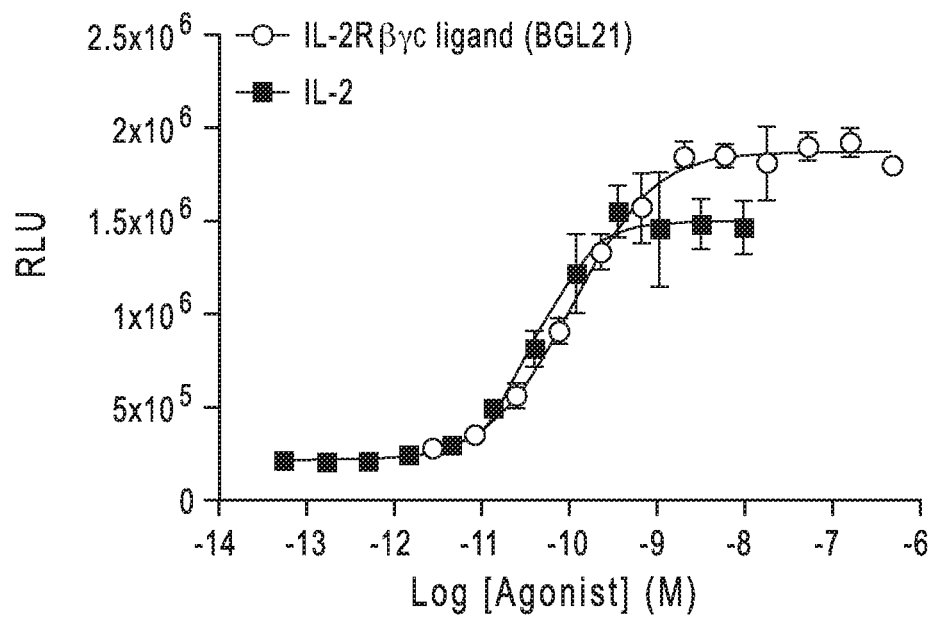
FIGS. 8A and 8B show NK-92 cell proliferation following exposure to either IL-2 or to IL-2Rβγc ligand (BGL21) in terms of viable cell number or % Ki-67+ cells, respectively.

The results are provided in FIG. 8A.

NK-92 cell proliferation in response to IL-2Rβγc ligand (BGL21) or IL-2 was also measured using Ki67 staining. The nuclear protein Ki67 is present during all active phases of the cell cycle but is absent in resting cells. NK-92 cells were resuspended in starvation medium and plated at $2 \times 10^5$ cells/well in a 96-well plate. Three-fold serial dilution of the test compound was then added to the cells for 48 h. Following the incubation period, cells were treated with Live/Dead® Fixable Aqua Dye (ThermoFisher No. L34966) for 30 min to stain for viable cells. The cells were then washed with PBS and then fixed and permeabilized for 1 h at 25° C. with Foxp3 Transcription Factor Fix/Perm® buffer (eBioscience No. 00-5523). Cells were washed and then stained with anti-Ki67 PE antibody. After a final wash the cells were analyzed by flow cytometry on an LSR II instrument (Becton Dickinson). Data analysis was performed using FlowJo™ software. The median fluorescence intensity of Ki67+ cells was plotted as a function of test compound concentration.

Figure 8B:
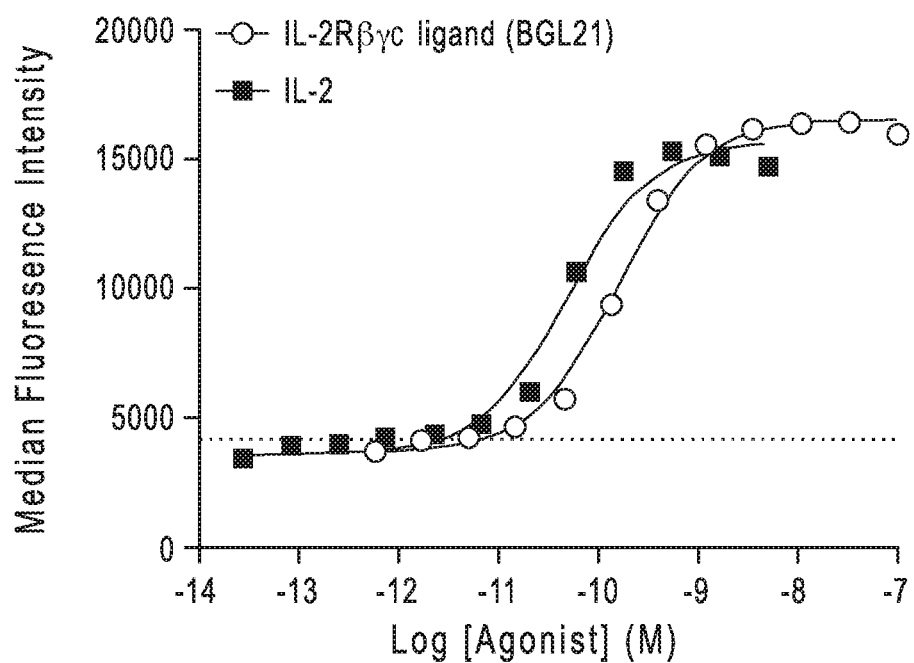

The results are provided in FIG. 8B.

The structure of the IL-2Rβγc ligand (BGL21) is provided in FIGS. 19A-19C.

Example 9

STAT-5 Phosphorylation in Resting CD8+ T-Cells, CD4+ T-Cells and Treg Cells

The agonist activity of IL-2 and an IL-2Rβγc ligand (IL-2Rβγc ligand (BGL21)), in resting CD8+ T-cells, CD4+ T-cells, and Treg cells was evaluated using a STAT5 phosphorylation assay.

Human peripheral blood mononuclear cells (PBMC) were isolated from buffy coats using Lymphoprep® (Stemcell Technologies #07811) density gradient centrifugation. The recovered PBMCs were resuspended in T-cell medium (CTS OpTmizer® medium+2 mM L-glutamine+Pen/Strep with no serum or IL-2) at $2 \times 10^6$ cells/mL and incubated for 3 h at 37° C. PBMCs were then added to a 96-well deep well plate at $10^6$ cells/well. Three-fold serial dilutions of IL-2Rβγc ligand (BGL21) or IL-2 were added to the cells and incubated for 30 min at 37° C. The cells were then fixed in Fix/Perm® buffer (Transcription Factor Phospho Buffer Set, BD Biosciences #563239) for 50 min on ice, followed by permeabilization in Perm Buffer III for 20 min on ice. Cells were washed several times using Perm/Wash® buffer. Antibody conjugates used for cell surface and intracellular staining are shown in Table 9.

TABLE 9

Antibody conjugates used for cell surface and intracellular staining.

| Marker | Clone | Channel | Supplier | Cat. No. |
| --- | --- | --- | --- | --- |
| CD127 | eBioRDR5 | FITC | Invitrogen | 11-1278-42 |
| pSTAT5 | 47 | PE | BD[1] | 612567 |
| CD25 | M-A251 | PE-CF594 | BD | 562403 |
| CD56 | CMSSB | PerCP- | Invitrogen | 46-0567-42 |
| CD16 | eBioCB16 | eF1710 | Invitrogen | 46-0168-42 |
| Foxp3 | 236A/E7 | AF647 | BD | 561184 |
| CD3 | UCHT1 | BV421 | BD | 562426 |
| CD8 | SK1 | BV510 | BD | 563919 |

[1]BD Biosciences.

Antibody mixtures were added to the cells and incubated for 30 min on ice and protected from light. Cells were washed with Perm/Wash® buffer and resuspended in PBS+ 2% FBS. Each test sample was analyzed by flow cytometry on an LSR II instrument (Becton Dickinson). Data analysis was performed using FlowJo™ software. The percent of pSTAT5+ cells in each blood cell population was plotted as a function of the concentration of test compound.

Figure 9A:
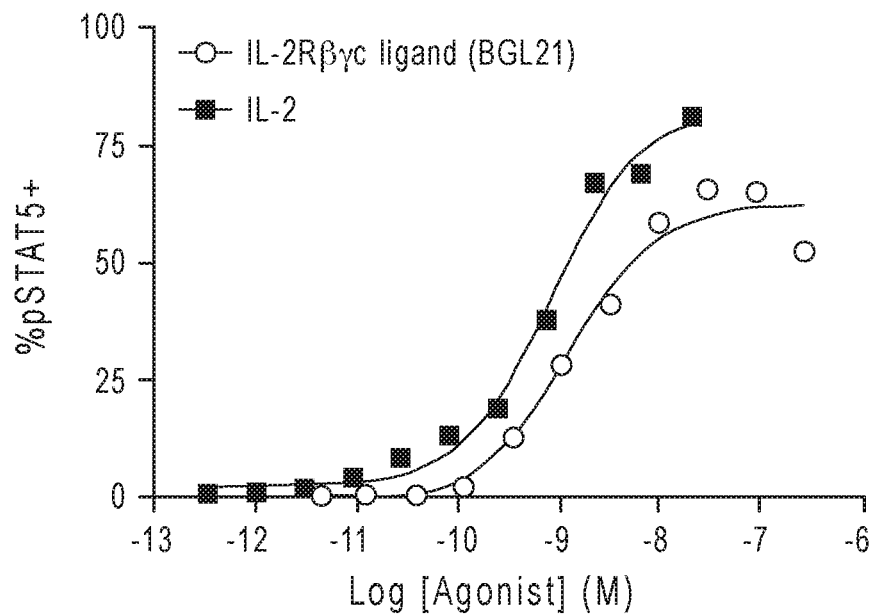
FIGS. 9A-9C show STAT5 phosphorylation in resting CD8+ T-cells, Treg cells, or CD4+ T-cells, respectively, following exposure to either IL-2 or to IL-2Rβγc ligand (BGL21).
Figure 9B:
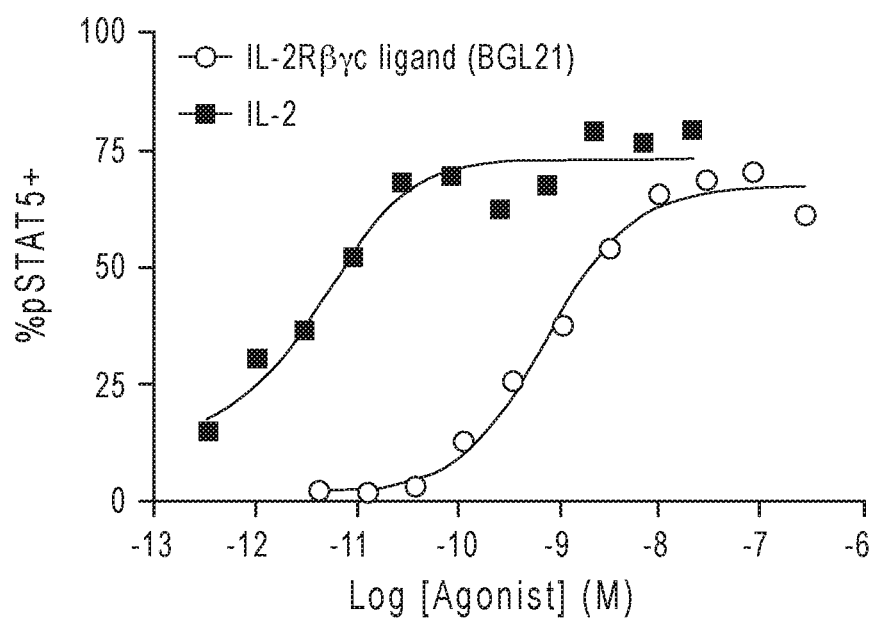
Figure 9C:
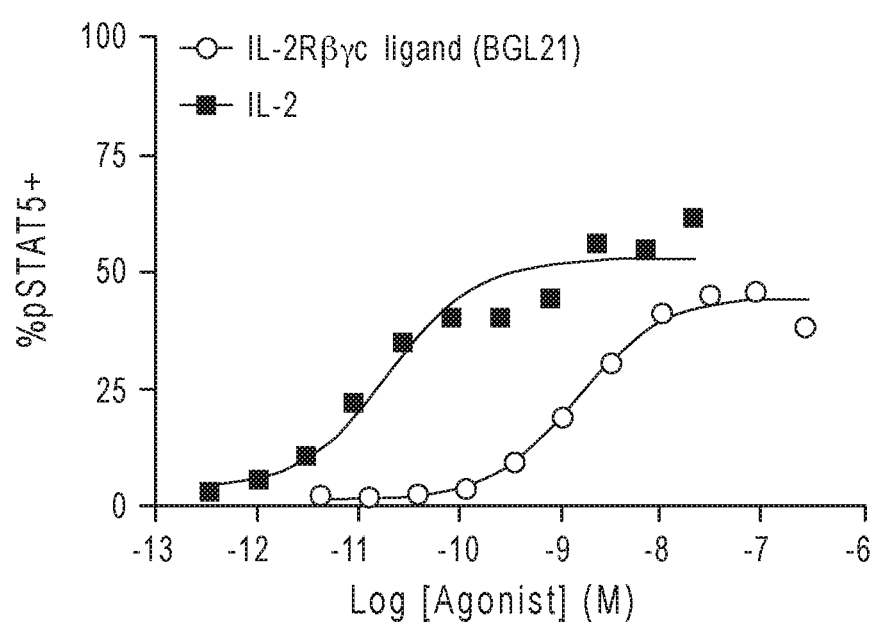

The results for STAT5 phosphorylation in resting CD8+ T-cells, CD4+ T-cells and Treg cells are presented in FIGS. 9A-9C, respectively.

Example 10

Proliferation in NK Cells from Human PBMCs

Human PBMCs were isolated from a buffy coat by density gradient centrifugation (Lymphoprep®, Stemcell Technologies No. 07811) and cultured overnight in T-cell medium (CTS OpTmizer®, ThermoFisher #A1048501) at $3 \times 10^6$ cells/mL in a T75 flask. The following day, cells were resuspended in fresh medium and plated at $5 \times 10^5$ cells/well in a 96-well cell culture plate. Three-fold serial dilutions of either IL-2 or an IL-2Rβγc ligand (BGL21) were added to the cells and incubated for 3 days at 37° C. After the treatment, cells were incubated in viability dye (Live/Dead® Fixable Aqua Cell Stain Kit, ThermoFisher #L34965) for 30 min at 37° C., after which surface antibody staining was then performed in PBS+2% FBS for 30 min on ice. Cells were fixed and permeabilized with Fixation/Permeabilization Buffer (eBioscience Foxp3/Transcription Staining Buffer Set, ThermoFisher #00-5523-00) for 30 min on ice. Intracellular (Ki-67) staining was performed in Permeabilization Buffer for 30 min on ice and the treated cells resuspended in PBS+2% FBS prior to FACS analysis. NK cells were identified as CD56+ and/or CD159a+ cells from CD3− and CD20− (non-T, non-B cell) populations. Antibody conjugates used for cell surface and intracellular staining are shown in Table 10.

(E:T) of 10:1. Serial dilutions of an IL-2Rβγc ligand (BGL21) or IL-2 were added to the wells and the cells were incubated at 37° C. for 48 h. PBMCs were then aspirated from the wells and the adherent A549 cells were collected using 0.25% (w/v) Trypsin-0.53 mM EDTA solution. Cells were washed with PBS and stained with the antibody mixture presented in Table 11 to quantify the levels of PD-L1 expression on A549 cells and to exclude PBMCs from the analysis.

TABLE 11

| Cell-staining antibody mixture. | | | | | |
|---|---|---|---|---|---|
| Marker | CD14 | PD-L1 | CD56 | CD20 | CD3 |
| Channel | FITC | PE | PerCP-eF1710 | PE-Cy7 | BV421 |

Samples were analyzed by flow cytometry on an LSR II instrument (Becton Dickinson). The percent of A549 cells staining positive for PD-L1 was plotted as a function of the concentration of the test compound.

Figure 11A:
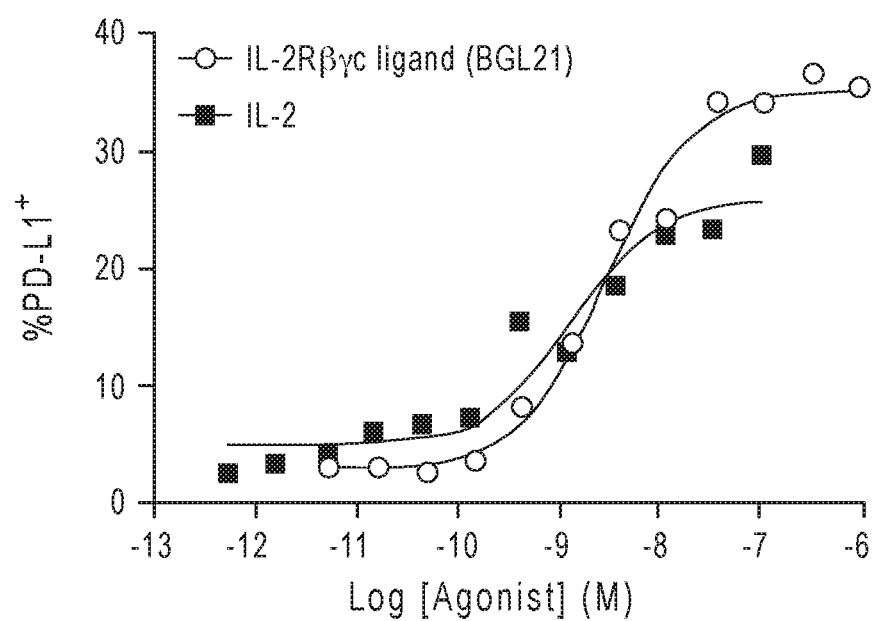
FIG. 11A shows the upregulation of PD-L1 expression in A549 tumor cells following co-culture with PBMCs and either IL-2 or IL-2Rβγc ligand (BGL21).

The results are presented in FIG. 11A.

Example 12

PBMC Tumor Cell Lysis

Freshly isolated PBMCs (effector cells) were resuspended in T-cell medium (CTS OpTmizer medium+2 mM L-glutamine+Pen/Strep with no serum or hIL-2) and plated at $6 \times 10^5$ cells/well in a 96-well cell culture plate. Human colon carcinoma cell lines LS180 (ATCC CL-187) and COLO 205 (ATCC CCL-222) (target cells) were added to the PBMCs at $3 \times 10^4$ cells/well for a final E:T ratio of 20:1. Dilutions of an IL-2Rβγc ligand (BGL21) or IL-2 were then added to the wells and the cells were incubated at 37° C. for 48 hours. Cell supernatants were collected by centrifugation and 50 µL from each well was transferred to a 96-well plate. Tumor cell

TABLE 10

| Antibody conjugates used for cell surface and intracellular staining. | | | | | | | |
|---|---|---|---|---|---|---|---|
| Marker | CD3 | Ki-67 | CD56 | CD20 | CD45RA | CD8 | CD159a | Live/Dead |
| Fluor | FITC | PE | PerCP-eFluor710 | PE-Cy7 | APC | BV421 | BV650 | Aqua |
| Clone | UCHT1 | SolA15 | CMSSB | 2H7 | HI100 | SK1 | 131411 | — |
| Vendor | Invitrogen | Invitrogen | Invitrogen | BioLegend | BD | BioLegend | BD | Invitrogen |
| Cat. No. | CD0301 | 12-2698-82 | 46-0567-42 | 302312 | 550855 | 344748 | 747920 | L349650 |

Figure 10A:
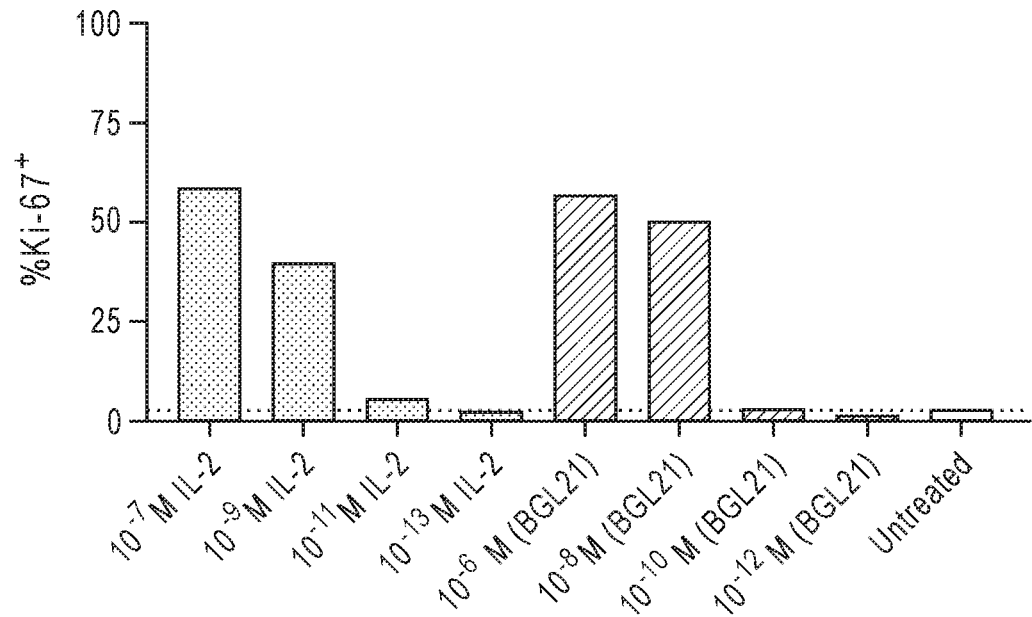
FIGS. 10A and 10B show proliferation of NK-92 cells following exposure to either IL-2 or to IL-2Rβγc ligand (BGL21) in terms of % Ki-67+ cells and median fluorescence intensity, respectively.
Figure 10B:
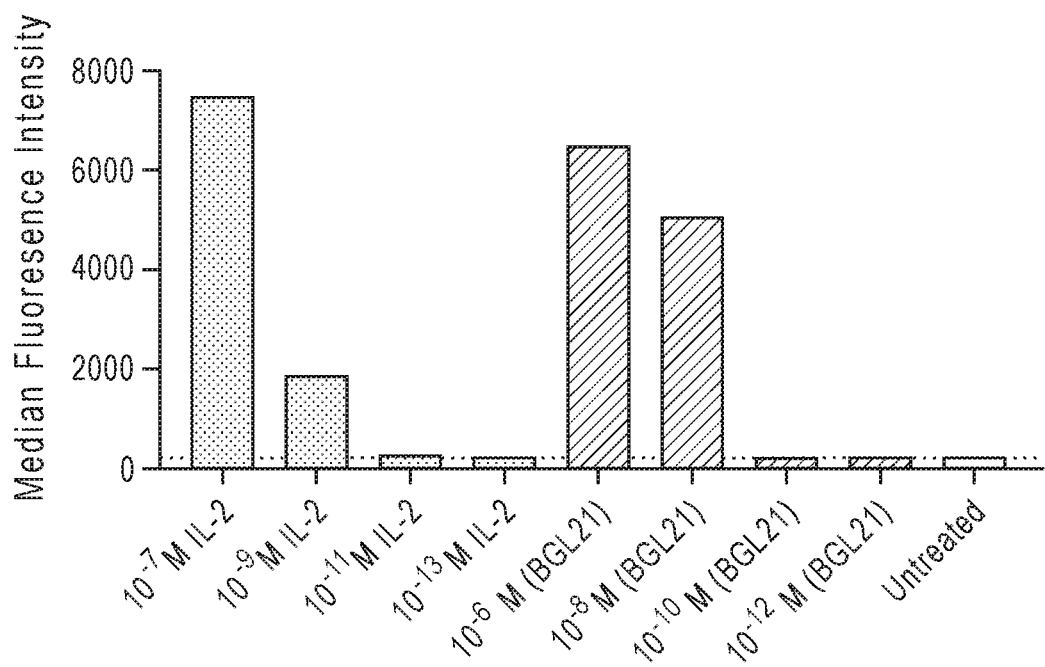

The results are presented in FIGS. 10A and 10B.

Example 11

Upregulation of PD-LI in A549 Tumor Cells and Tumor Cell Lysis PD-L1 Upregulation Human peripheral blood mononuclear cells (PBMC) were isolated from buffy coats by density gradient centrifugation. Human lung carcinoma A549 cells (ATCC CCL-185) were seeded overnight in 6-well plates at $10^6$ cells/well. The following day, freshly isolated PBMCs were added to the A549 cells at $10^7$ cells/well for a final effector-to-target ratio lysis was quantified by measuring LDH release with the Promega CytoTox 96® Non-Radioactive Cytotoxicity Assay Kit (No. G1780). An equal volume of CytoTox 96® reagent was added to each well and incubated at 25° C. for 30 min. Stop solution (50 µL) was then added to each well to terminate the reaction and the absorbance signal was measured at 490 nm in a Wallac Victor 1420® plate reader. The percent cytotoxicity was calculated by dividing the value obtained for each sample by the maximum value obtained from supernatants obtained from wells treated with lysis buffer.

Figure 11B:
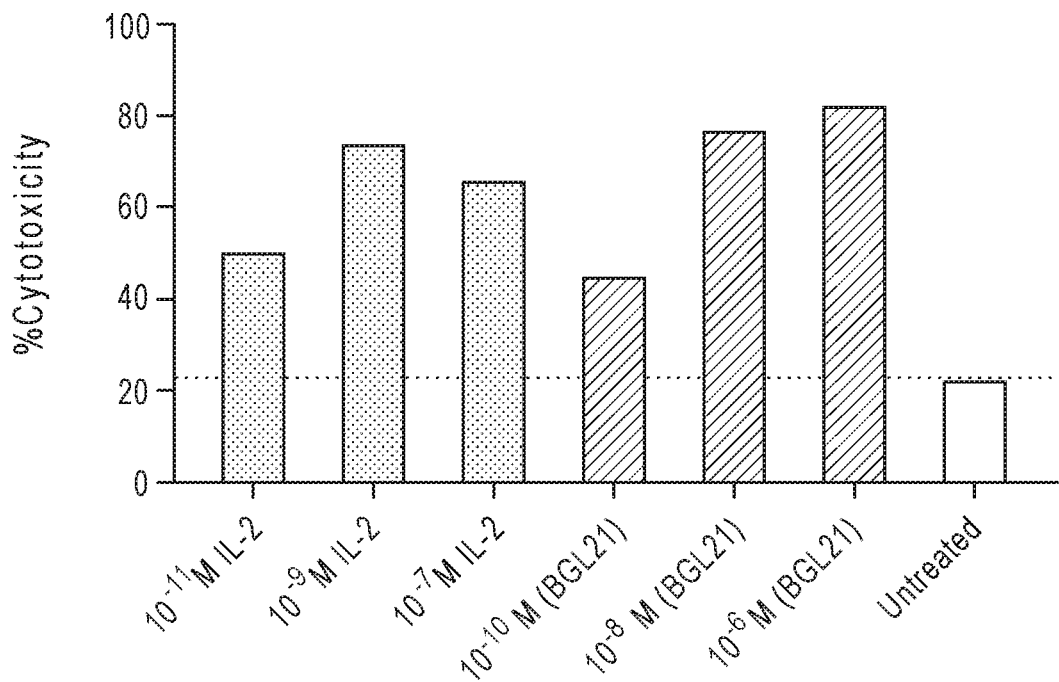
FIGS. 11B and 11C show the % cytotoxicity in LS180 cells and the % cytotoxicity in COLO205 cells, respectively, following co-culture with PBMCs and either IL-2 or IL-2Rβγc ligand (BGL21).
Figure 11C:
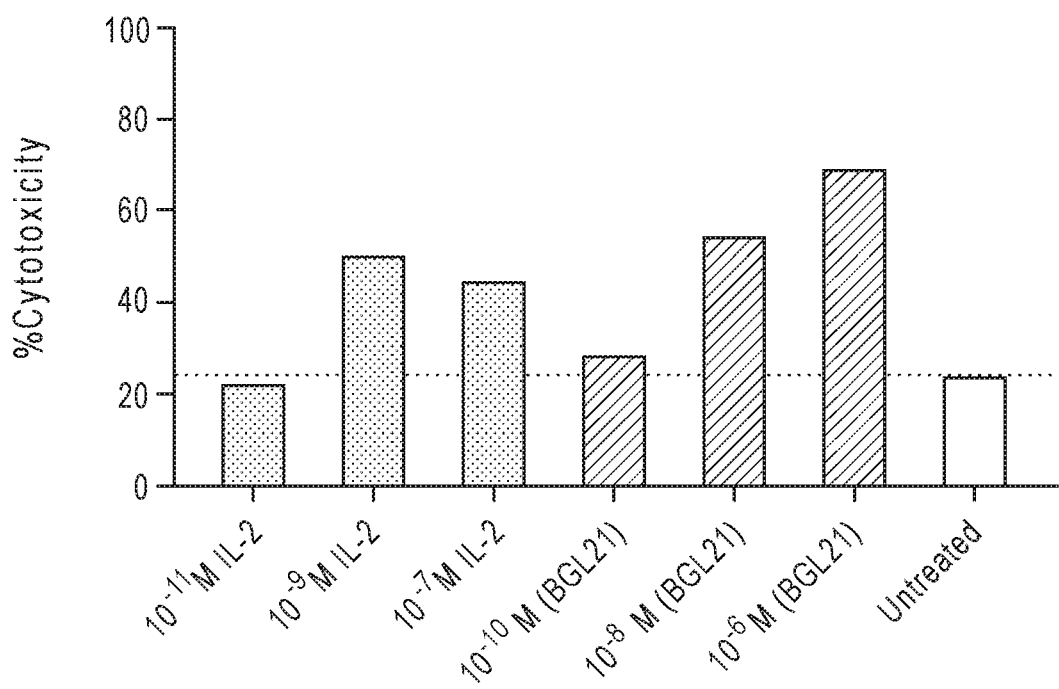

The results are presented in FIGS. 11B and 11C for the cytotoxicity of LS180 cells and Colo205 cells, respectively.

Example 13

Recombinant Fusion Proteins Incorporating an IL-2Rβγc Ligand

Immunoglobulin Fusions: Multiple mammalian expression vectors were constructed to express IL-2Rβγc ligands linked to full-length human IgG, or to Fc-fragments consisting of the CH2 and CH3 domains of the heavy chain and hinge regions of human IgG1, IgG2, or IgG4. Each vector contained a strong constitutive promoter (CMV or hEF1-HTLV) and an IL-2 signal peptide sequence for secretion of the fusion protein into the culture media. Vectors were designed to enable peptide ligands to be fused to either the N- or C-terminus of the immunoglobulin proteins and to incorporate construct linkers of varying lengths between the IL-2Rβγc ligands and IgG.

Fusion proteins were transiently expressed in 293 human embryonic kidney cells (FreeStyle® 293-F) by transfecting plasmid DNA into the cells using polyethyleneimine reagent PEI MAX (Polysciences, Inc.). Transfected cells were grown in FreeStyle® 293 Expression Medium (Thermo Fisher) in shaker flasks in a 37° C. humidified $CO_2$ incubator on an orbital shaker rotating at 125 rpm. Cultures were harvested 96 h post-transfection by centrifugation and the secreted fusion proteins were purified from the supernatants using protein A affinity chromatography.

Protein A agarose resin was mixed with culture supernatant and incubated at room temperature for several hours. The resin was then washed three times with PBS and bound IgG IL-2Rβγc ligand fusion was eluted with 0.1 M glycine buffer (pH 2.8). Eluates were neutralized with 1M Tris buffer and quantified by measuring absorbance at 280 nm using a NanoDrop® spectrophotometer. Protein concentrations were determined using calculated extinction coefficients derived from the primary sequence of the protein. Size exclusion chromatography was used to remove high molecular weight impurities prior to measuring the activities of the fusion proteins in bioassays.

Human Serum Albumin Fusion: A mammalian expression vector was constructed to express IL-2Rβγc ligands linked to the C-terminus of human serum albumin (HSA). A 6×-His tag (SEQ ID NO: 9617) was linked to the N-terminus of HSA for purification purposes. The vector contains a strong constitutive promoter (hEF1-HTLV) and an IL-2 signal peptide sequence for secretion of the fusion protein into the culture media.

HSA-IL-2Rβγc ligand fusion protein was transiently expressed in 293 human embryonic kidney cells (FreeStyle® 293-F) by first transfecting plasmid DNA into the cells using polyethyleneimine reagent PEI MAX (Polysciences, Inc.). Transfected cells were grown in FreeStyle® 293 Expression Medium (Thermo Fisher) in shaker flasks in a 37° C. humidified $CO_2$ incubator on an orbital shaker rotating at 125 rpm. Cultures were harvested 96 h post-transfection by centrifugation and the secreted HSA-IL-2Rβγc ligand fusion protein was purified from the supernatant by Ni-NTA affinity chromatography.

Ni-NTA agarose resin was added to the culture supernatant and incubated at room temperature for several hours. The resin was then washed three times with TBS wash buffer (25 mM Tris pH 8.0, 150 mM NaCl, 20 mM imidazole). Bound HSA-IL-2Rβγc ligand fusion protein was eluted from the resin with elution buffer (25 mM Tris pH 8.0, 150 mM NaCl, 250 mM imidazole) followed by buffer exchange to remove imidazole using Zeba® spin columns (Thermo Fisher). Protein was quantified by measuring absorbance at 280 nm using a NanoDrop® spectrophotometer and concentration was determined using calculated extinction coefficients derived from the primary sequence of the protein.

The amino acid sequences of the IL-2Rβγc ligand fusion proteins used in the experimental examples is provided in FIGS. 20A-20J and 21A-21C.

The hIgG2 Fc-fragment refers to the Fc region consisting of the CH2 and CH3 domains of the IgG2 heavy chain and the hinge region. The first and second cysteines of the hinge region were replaced with serine to prevent detrimental disulfide bridges. The last amino acid (lysine) of the Fc region was replaced with an alanine for fusion stability. The N-terminus of IgG2 Fc constructs starts with Ala-Pro-Leu (derived from InvivoGen vector).

The hIgG1v Fc-fragment refers to the Fc region consisting of the CH2 and CH3 domains of the IgG1 heavy chain and the hinge region. The first cysteine of the hinge region was replaced with a serine to prevent disulfide bridges. The last amino acid (lysine) of the Fc region was replaced with an alanine for fusion stability. Effector silencing mutations P329G, L234A/L235A (LALA) were included in the IgG1v Fc-(BGL21) construct (FP2) (SEQ ID NO: 8013). The N-terminus of the IgG1v Fc construct starts with Ala (derived from InvivoGen vector).

The hIgG4 Fc-fragment refers to the Fc region consisting of the CH2 and CH3 domains of the IgG4 heavy chain and the hinge region. Effector silencing mutations P329G, S228P/L235E (SPLE) were included in the hIgG4 Fc variant (FP3) (SEQ ID NO: 8014).

Fc-Knob refers to the Human Hinge Knob Fc IgG1 LALA-dK (decreased effector function and low C-terminal heterogeneity) (L252A, L253A, T384W).

Fc-Hole refers to the Human Hinge Hole Fc IgG1 LALA-dK (decreased effector function and low C-terminal heterogeneity) (L252A, L253A, T384S, L386A, Y425V).

The hIgG1 Fc-fragment refers to the Fc region consisting of the CH2 and CH3 domains of the IgG1 heavy chain and the hinge region. The last amino acid (lysine) of the Fc region was replaced with alanine for fusion stability. The construct includes effector silencing mutation N297A.

The hIgG2 Fc-fragment refers to the Fc region consisting of the CH2 and CH3 domains of the IgG2 heavy chain and the hinge region. The first and second cysteines of the hinge were replaced with serines to prevent disulfide bridges. The last amino acid (lysine) of the Fc region was replaced with alanine for fusion stability.

Example 14

STAT5 Phosphorylation in TF-1β Cells with IL-2Rβγc Ligand Fusion Proteins

IL-2Rβγc ligand (BGL21) was fused to an IgG Fc-fragment consisting of the CH2 and CH3 domains of the heavy chain and hinge regions of human IgG2 (C-terminal fusion SEQ ID NO: 1212; N-terminal fusion SEQ ID NO: 1215) as described in Example 13. IL-2Rβγc ligand (BGL21) was also fused to a heterodimeric Fc-fragment (Knob-into-holes) variant consisting of the CH2 and CH3 domains of the heavy chain and hinge regions of human IgG1. IL-2Rβγc ligand (BGL21) was fused to the C-terminus of the knob-Fc-fragment (SEQ ID NO: 1216) which contains a "knob" mutation (T366W) and effector silencing mutations (L234A/L235A). The construct was co-expressed with a hole-Fc-fragment (SEQ ID NO: 1217), which contains "hole" mutations (T366S, L368A, Y407V) and effector silencing mutations (L234A/L235A), to produce a heterodimeric Fc-fragment with a single copy of an IL-2Rβγc ligand (BGL21) at the C-terminus of the fusion protein. In addition to fusions to Fc-fragments, an IL-2Rβγc ligand (BGL21) was also fused to the C-terminus of human serum albumin (SEQ ID NO: 1252) as described in Example 13.

Fusion proteins were incubated with TF-1β cells and STAT5 phosphorylation was measured as a function of concentration using the methods described in Example 3.

The structure of the IL-2Rβγc ligand fusion proteins is provided in FIGS. 20A-20J and 21A-21C.

Figure 12:
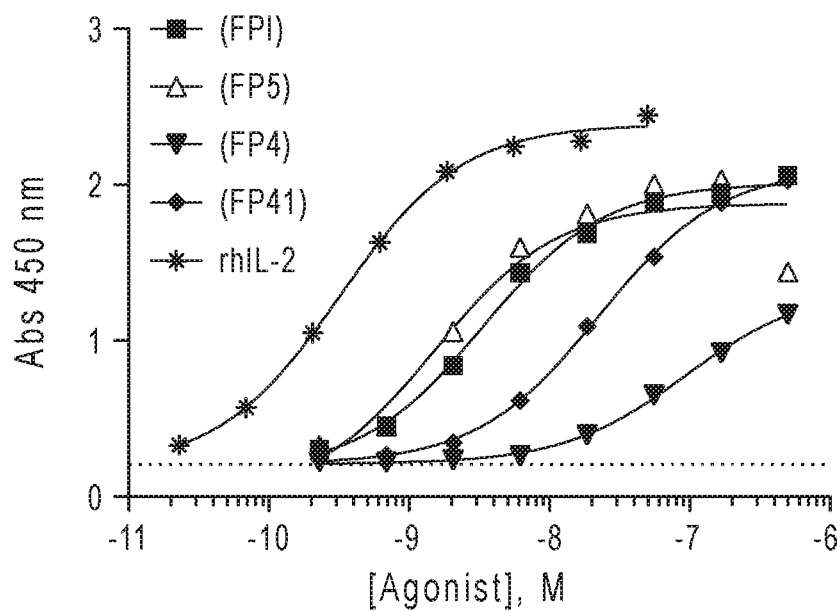
FIG. 12 shows the STAT5 phosphorylation in TF-1β cells following exposure to IL-2 or to various IL-2Rβγc ligand (BGL21)-fusion proteins.

The results are presented in FIG. 12.

Example 15

STAT5 Phosphorylation in TF-1β Cells with Different IL-2Rβγc Ligand IgG2 Fc-Fragment Fusion Proteins A series of IL-2Rβγc ligands were fused to the C-terminus of an IgG2 Fc-fragment consisting of the CH2 and CH3 domains of the heavy chain and hinge regions of human IgG2 as described in Example 13. The IL-2Rβγc ligands included IL-2Rβ and Rγc ligands exhibiting various binding affinities to IL-2R that were linked together with a flexible linker $(GGGGS)_2$ (SEQ ID NO: 9396) between the two peptide sequences.

Fusion proteins were incubated with TF-1β cells and STAT5 phosphorylation was measured as a function of concentration using the methods described in Example 3.

The structures of the Fc-IL-2Rβγc ligand fusion proteins evaluated is provided in FIGS. 20 and 23 as SEQ ID NOS: 8012, 8039, 8043, 8044, 8050, and 8051.

Figure 13:
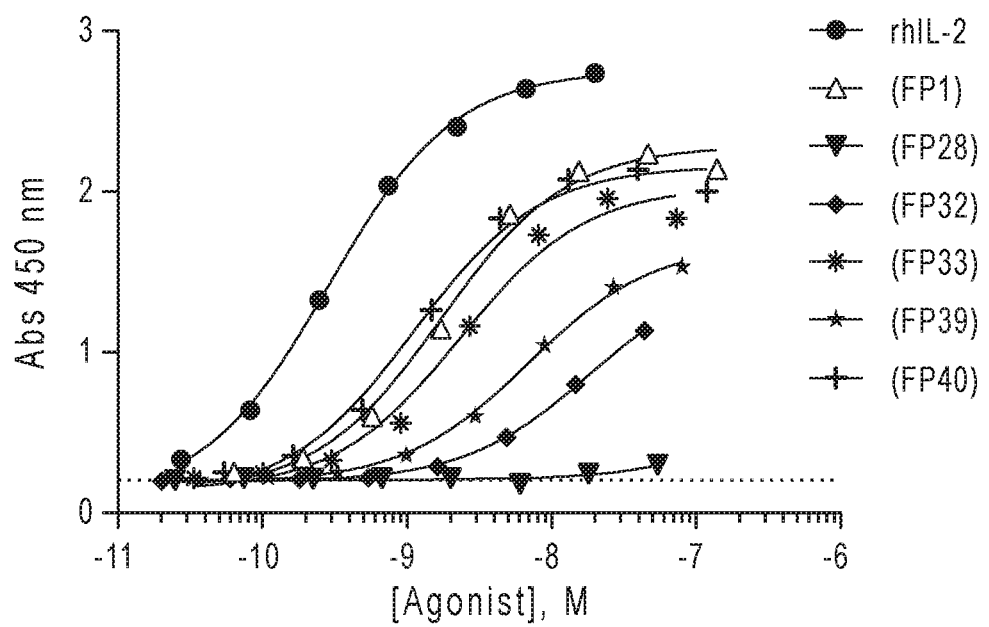
FIG. 13 shows the STAT5 phosphorylation in TF-1β cells following exposure to IL-2 or to various IL-2Rβγc ligand-Fc fusion proteins having different IL-2Rβγc ligands.

The results are presented in FIG. 13.

Example 16

STAT5 Phosphorylation in NK-92 Cells with Fusion Proteins Including an IL-2Rβγc Ligand Bound to the Fc-Fragment of Different IgG Isotypes An IL-2Rβγc ligand (BGL21) was fused to Fc-fragments consisting of the CH2 and CH3 domains of the heavy chain and hinge regions of three different isotypes of human IgG. In the first construct (FP2; SEQ ID NO: 8013) IL-2Rβγc ligand (BGL21) was fused to the C-terminus of a human IgG1 Fc-fragment variant in which the first cysteine in the hinge region was replaced by a serine to prevent detrimental disulfide bridges and the last amino acid (lysine) was replaced by alanine for fusion stability. Effector silencing mutations were also included in this variant (P329G, L234A/L235A). The second construct (FP1; SEQ ID NO: 8012) IL-2Rβγc ligand (BGL21) was fused to the C-terminus of a human IgG2 Fc-fragment variant in which the first and second cysteines in the hinge region were replaced by serine to prevent disulfide bridges and the last amino acid (lysine) was replaced by alanine for fusion stability. In a third construct (FP3; SEQ ID NO: 8014) an IL-2Rβγc ligand (BGL21) was fused to the C-terminus of a human IgG4 Fc-fragment variant that contained effector silencing mutations (P329G, S228P/L235). Each fusion protein was expressed and purified as described in Example 13.

Fusion proteins were incubated with TF-1β cells and STAT5 phosphorylation was measured as a function of concentration using the methods described in Example 3.

The structure of the IgG Fc-IL-2Rβγc ligand fusion proteins (FP1)-(FP3) is provided in FIGS. 20A-20J and 21A-21C and correspond to SEQ ID NOS: 8012, 8013, and 8014.

Figure 14:
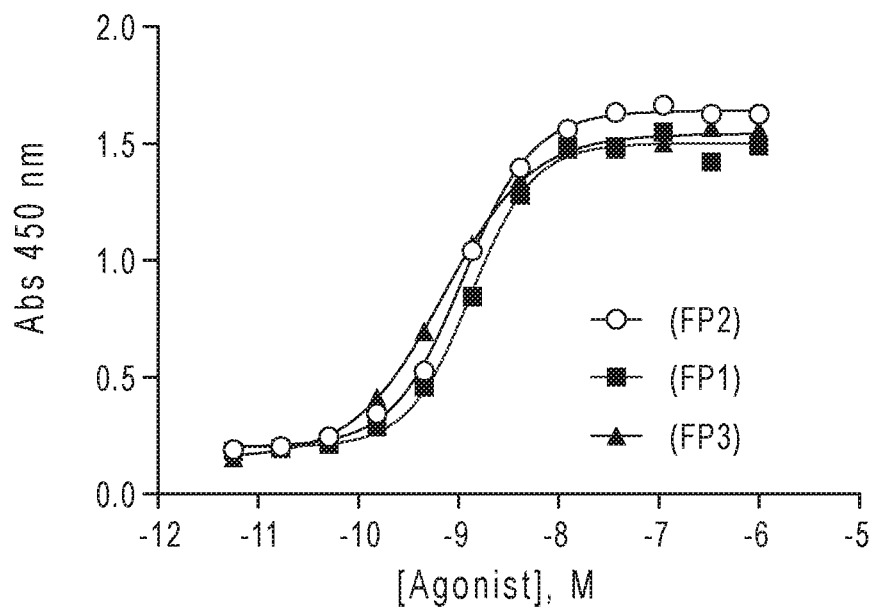
FIG. 14 shows the STAT5 phosphorylation in TF-1β cells following exposure to various IL-2Rβγc ligand (BGL21)-Fc fusion proteins derived from different IgG isotypes.

The results are presented in FIG. 14.

Example 17

STAT5 Phosphorylation in TF-1β Cells with IL-2Rβγc Ligand IgG2 Fc-Fragment Fusion Proteins Having Different Fc Linkers IL-2Rβγc ligand (BGL21) IgG2 Fc-fragment variants containing a series of flexible construct linkers with glycine or glycine/serine repeats, or rigid construct linkers with proline/alanine repeats between the Fc-fragment and the C-terminal IL-2Rβγc ligand (BGL21) were prepared as described in Example 13.

The fusion proteins were incubated with TF-1β cells and STAT5 phosphorylation was measured as a function of concentration using the methods described in Example 3.

The structure of the Fc-IL-2Rβγc ligand fusion proteins is provided in FIGS. 20A-20J and 21A-21C and correspond to IL-2Rβγc ligand fusion proteins (FP16)-(FP24) having SEQ ID NOS: 8027-8035, respectively.

Figure 15:
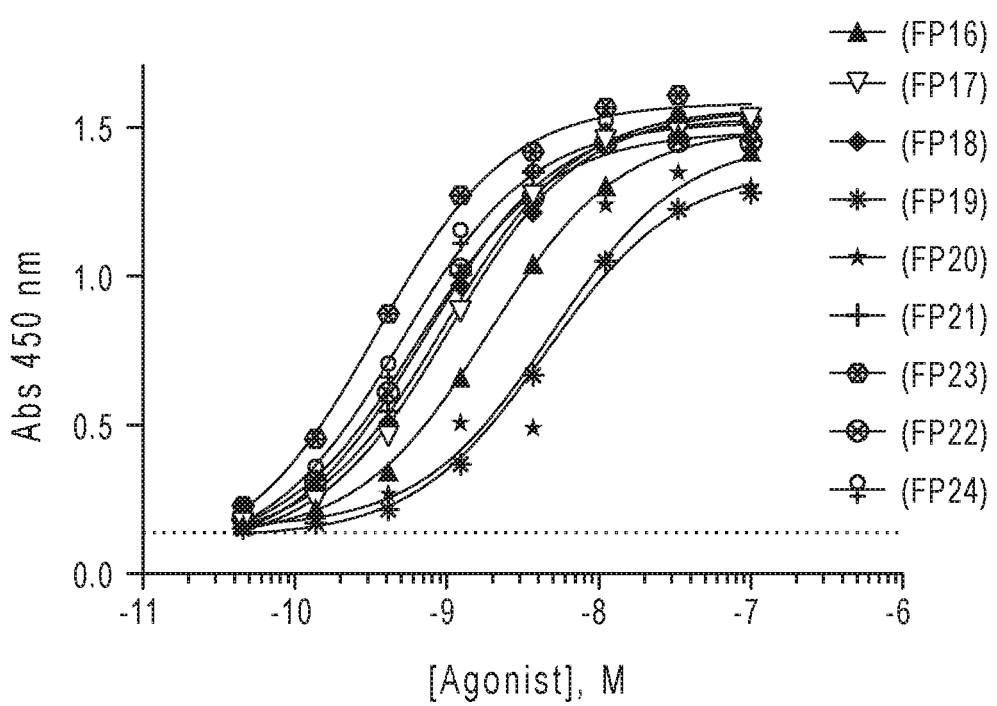
FIG. 15 shows the STAT5 phosphorylation in TF-1β cells following exposure to IL-2Rβγc ligand (BGL21)-Fc fusion proteins having different Fc linkers.

The results are presented in FIG. 15.

Example 18

STAT5 Phosphorylation in TF-1β Cells and NK-92 with IL-2Rβγc Ligand IgG2 Fc-Fragment Fusion Proteins Having Different Fc Linkers IL-2Rβγc ligand (BGL21) IgG2 Fc-fragment variants that contained a flexible linker consisting of a $(GS)_{10}$ (SEQ ID NO: 9407) (see FP14; SEQ ID NO: 8025) flexible linker or a rigid linker consisting of $(PA)_{10}$ (SEQ ID NO: 9428) (see FP15; SEQ ID NO: 8026) between the IgG2 Fc-fragment and the C-terminus of IL-2Rβγc ligand (BGL21) were prepared as described in Example 13.

The fusion proteins were incubated with TF-1β cells and STAT5 phosphorylation was measured as a function of concentration using the methods described in Example 3. Each fusion protein was also tested in a NK-92 cell proliferation assay using Ki67 staining to quantify cells that proliferated in response to the compounds as described in Example 9.

The structures of the Fc-IL-2Rβγc ligand fusion proteins are provided in FIGS. 20A-20J and 21A-21C.

Figure 16A:
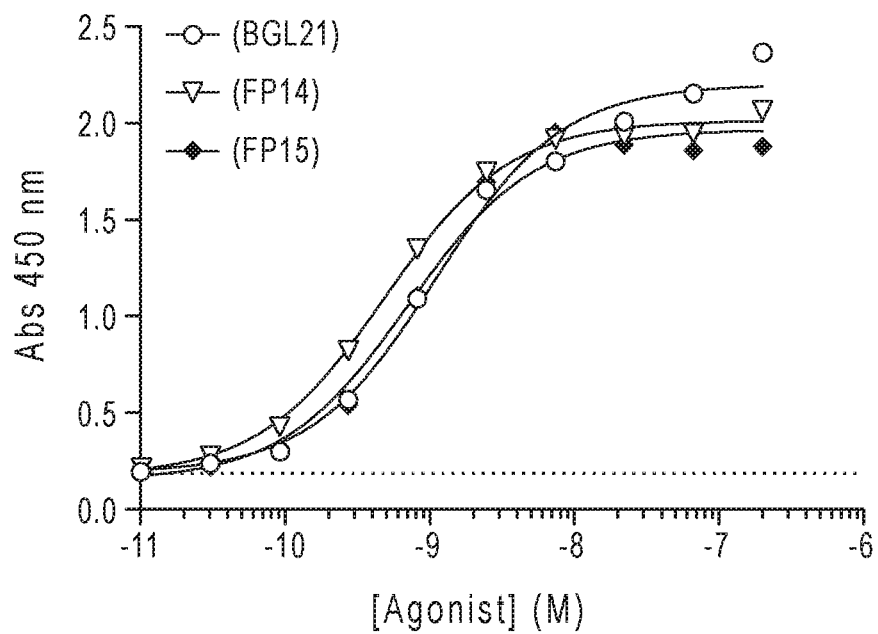
FIGS. 16A and 16B show the STAT5 phosphorylation in TF-1β cells (FIG. 16A) or % Ki-67 activity (FIG. 16B) in NK-92 cells following exposure to IL-2Rβγc ligand (BGL21) or to IL-2Rβγc ligand (BGL21)-Fc fusion proteins having different Fc linkers.
Figure 16B:
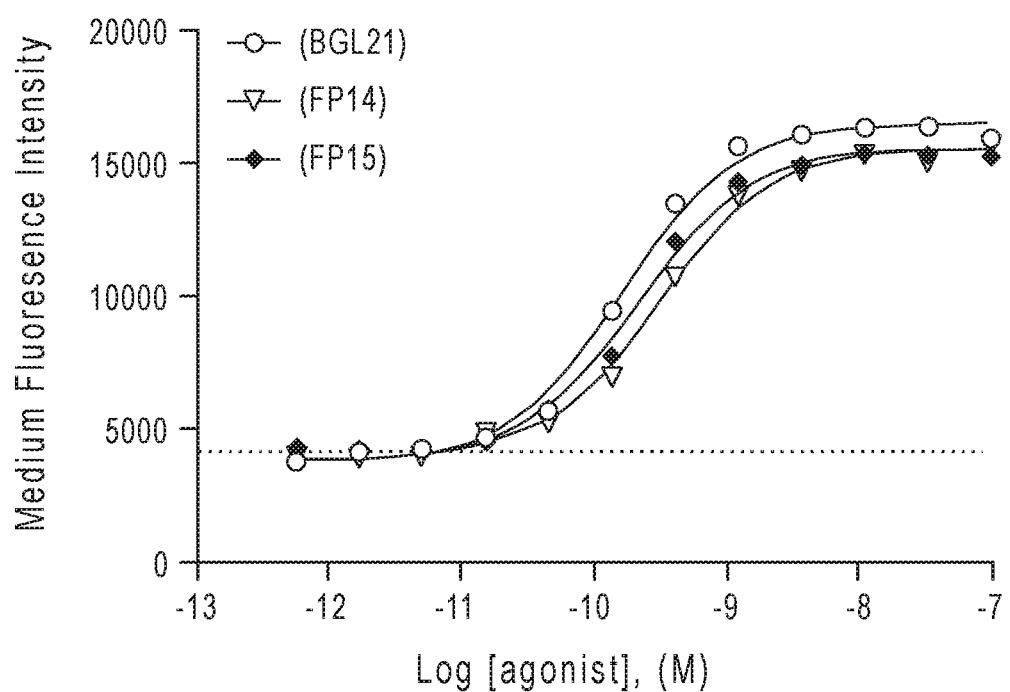

The results are presented in FIGS. 16A and 16B.

Example 19

PD-1 Binding and IL-2 Agonist Activity of Anti-PD-1 Antibody-IL-2βγc Ligand (BGL21) Fusion Proteins An IL-2Rβγc ligand (BGL21) was fused to the C-terminus of the heavy chains of two therapeutic checkpoint inhibitor antibodies that target PD-1 (Pembrolizumab (FP8) (SEQ ID NO: 8019); and Cemiplimab (FP10) (SEQ ID NO: 8021)) as described for heterodimeric peptide fusions to IgG Fc-fragments in Example 13. The constructs were transiently co-expressed with their corresponding light chain constructs ((Pembrolizumab (FP7; SEQ ID NO: 8018); Cemiplimab (FP9; SEQ ID NO: 8020)) in HEK-293F cells to produce full IgG IL-2Rβγc ligand (BGL21) fusions.

Figure 17A:
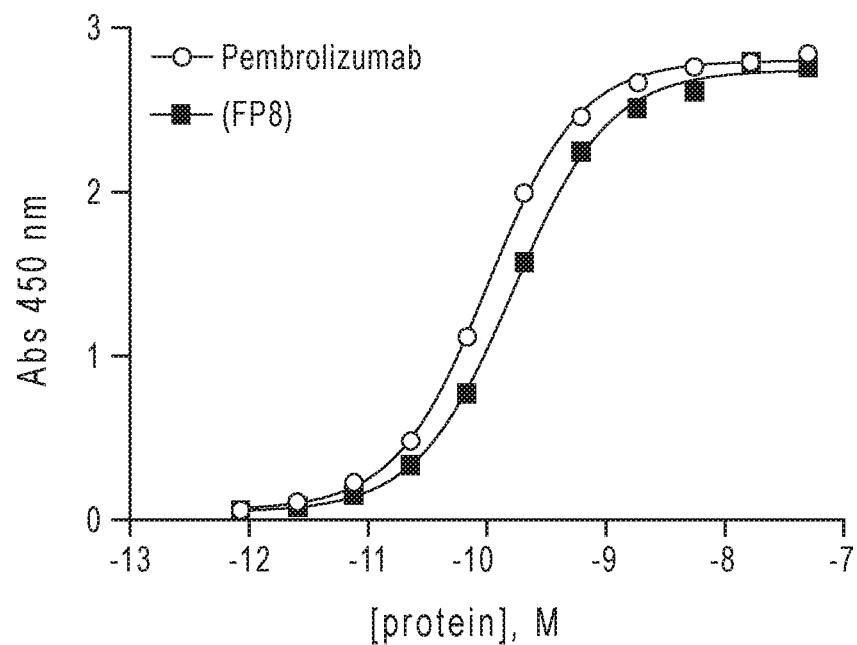
FIGS. 17A-17D show PD-1 binding affinity (FIGS. 17A and 17C) and IL-2R agonist activity as determined by STAT5 phosphorylation (FIGS. 17B and 17D) in TF-1β cells following exposure to an anti-PD-1 antibody (pembrolizumab or cemiplimab), to an IL-2Rβγc ligand (BGL21)-Fc fusion protein (FP1) (SEQ ID NO: 8012), or to an IL-2Rβγc ligand (BGL21)-anti-PD-1 antibody (FP8) (SEQ ID NO: 8019) and (FP10) (SEQ ID NO: 8021).
Figure 17B:
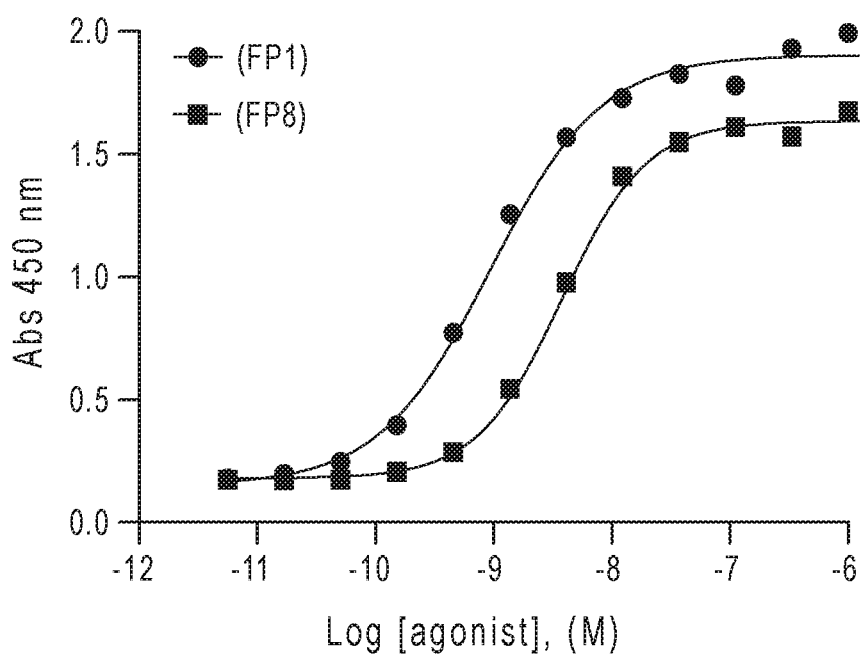
Figure 17C:
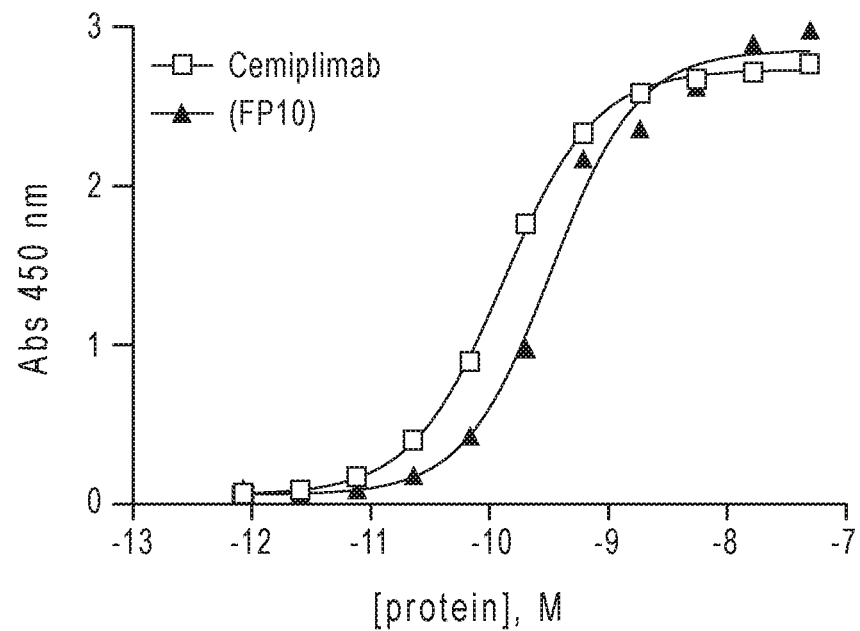

Purified proteins were evaluated for binding to PD-1 target protein by ELISA. Recombinant human PD-1 His tagged protein (R&D Systems 8986-PD-100) was dissolved in PBS at 1 µg/mL and directly immobilized in microtiter wells by absorption followed by blocking with PBS/1% BSA. Serial dilutions of Pembrolizumab and Cemiplimab antibodies or the corresponding IL-2Rβγc ligand (BGL21) fusion proteins were added to the wells and incubated for 1 h at 4° C. Wells were then washed with PBS and an anti-human IgG HRP-linked antibody was added to each well and incubated for 1 hour at 4° C. After a final wash TMB substrate solution was added to measure the amount of HRP in each well. Absorbance at 450 nm was read in a microplate reader. The signal that is produced is proportional to the quantity of antibody bound to PD-1 in each well. The result of the binding to PD-1 is shown in FIGS. 17A and 17C.

Figure 17D:
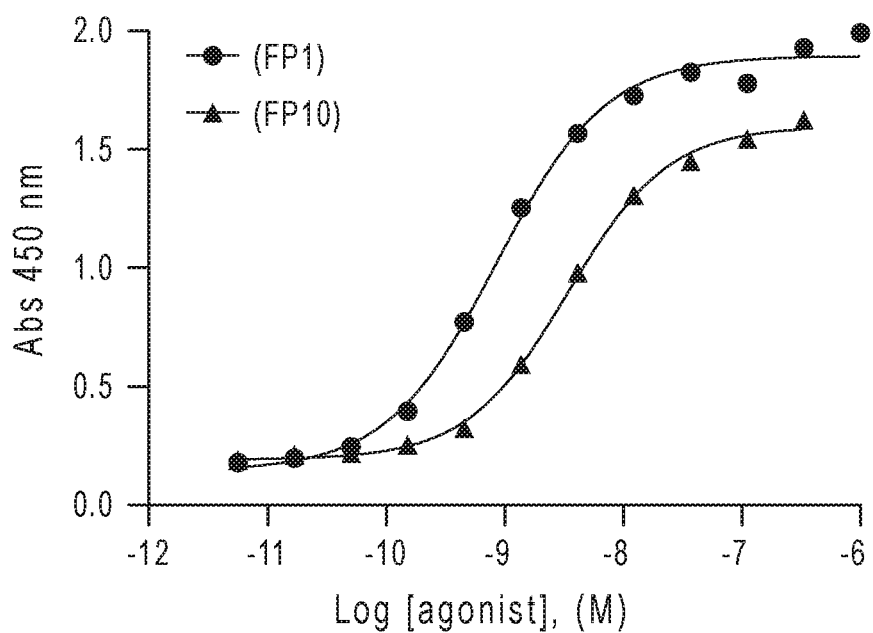

Pembrolizumab and Cemiplimab IL-2Rβγc ligand (BGL21) fusion proteins were incubated with TF-1β cells and STAT5 phosphorylation was measured as a function of concentration using the methods described in Example 3. The results of the STAT5 phosphorylation assay are shown in in FIGS. 17B and 17D, respectively.

The structures of the Fc-IL-2Rβγc ligand fusion proteins are provided in FIGS. 20A-20J and 21A-21C.

Example 20

Synthesis of PEGylated IL-2Rβγc Ligand Construct

An analog of IL-2Rβγc ligand (BGL21) was prepared as described in Example 1 except instead of acetylating the N-terminal primary amine with acetic anhydride, Fmoc-PEG$_{10}$-CH$_2$CH$_2$—CO$_2$H (Anaspec, Hayward, Calif.) was added to the N-terminus using a final HATU-mediated coupling step, and the Fmoc-protecting group was removed as described previously. Cleavage from the resin and disulfide formation were performed as described in Example 1 to provide the oxidized peptide with a free N-terminal primary amine. The IL-2Rβγc ligand (BGL21) (1.5 molar equivalents) was mixed with the NHS-ester of a 40 kD branched PEG reagent (1.0 molar equivalent) (NOF Corp., Tokyo, Japan) in dry DMF. After gentle stirring for 15 min at 25° C., DIEA (10 molar equivalents) was added, and the reaction allowed to proceed to completion (approx. 4 h; analysis by analytical C18 reverse phase HPLC). The final product (PEG-8) was purified by C18 reverse phase HPLC, and the structure of the PEGylated peptide was confirmed by MALDI ToF (time of flight) mass spectrometry and reverse phase HPLC.

Example 21

Agonist Activity of PEG-IL-2Rβγc Ligand

The PEG-IL-2Rβγc ligand construct synthesized in Example 20 (PEG-8) or IL-2 was incubated with NK-92 cells and STAT5 phosphorylation was measured as a function of concentration using the methods described in Examples 3 and 4.

Figure 18:
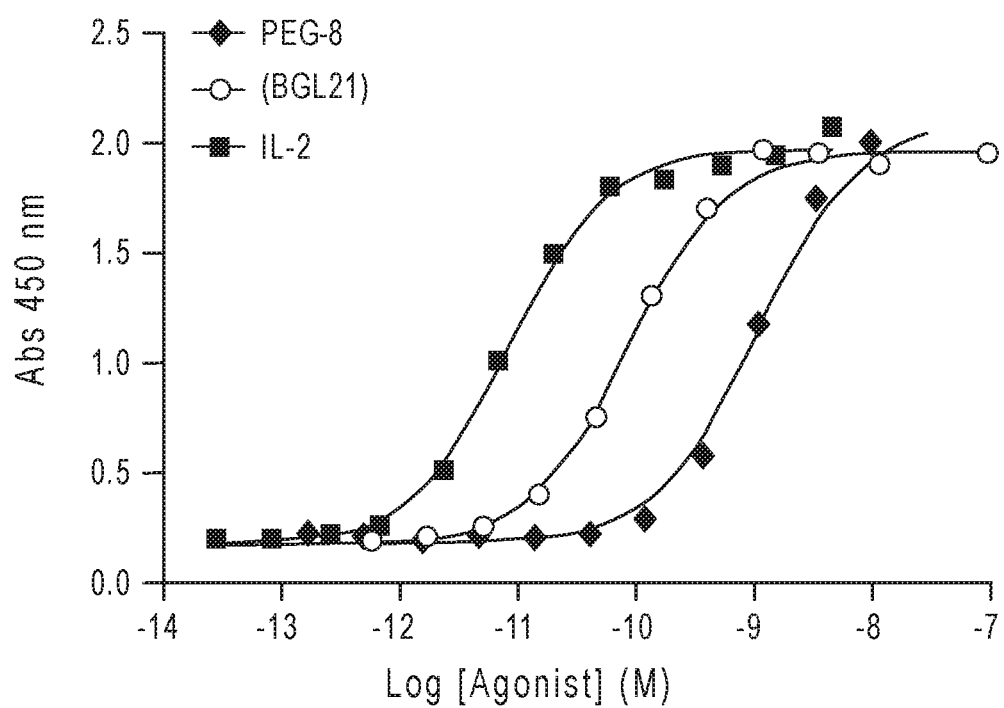
FIG. 18 shows the STAT5 phosphorylation in NK-92 cells following exposure to IL-2, to IL-2Rβγc ligand (BGL21), or to PEGylated IL-2Rβγc ligand (BGL21).
Figure 22A:
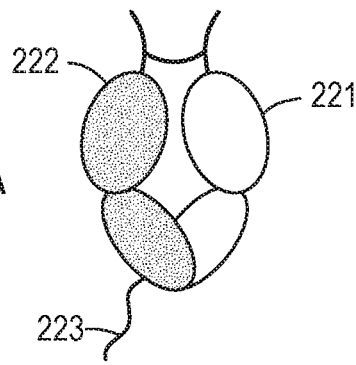
FIGS. 22A-22F show examples of various configurations of dual receptor binding Fc-fragment fusion proteins provided by the present disclosure.
Figure 22B:
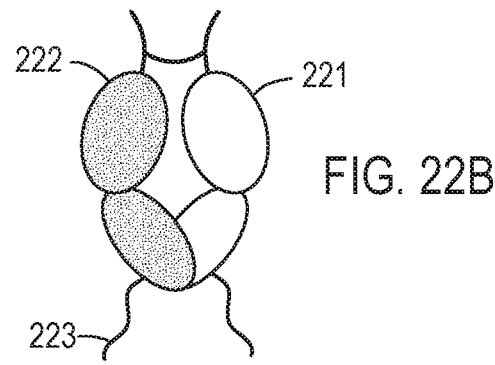
Figure 22C:
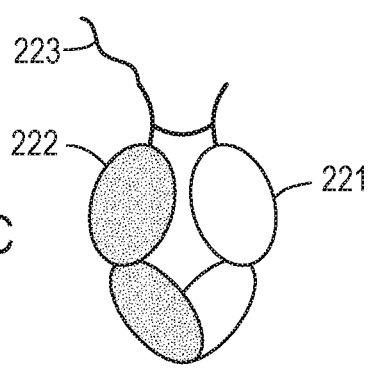
Figure 22D:
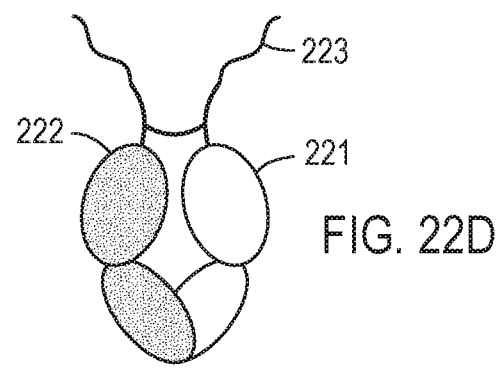
Figure 22E:
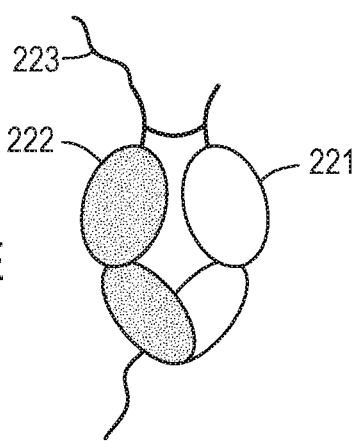
Figure 22F:
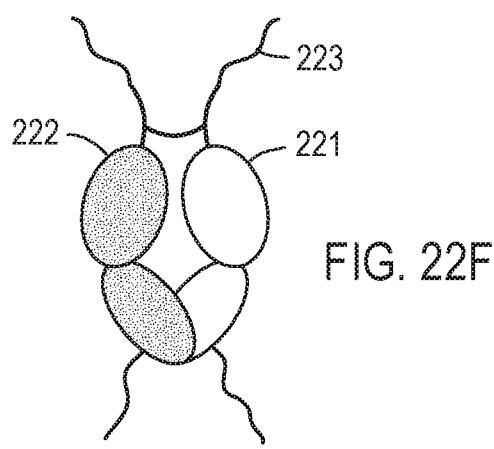
Figure 23A:
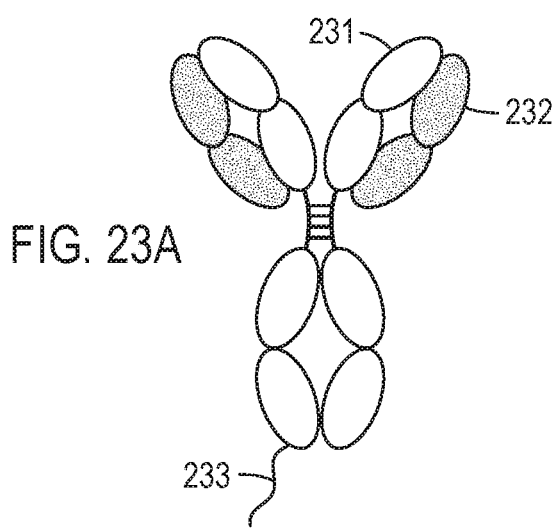
FIGS. 23A-23F show examples of various configurations of dual receptor binding immunoglobulin fusion proteins provided by the present disclosure.
Figure 23B:
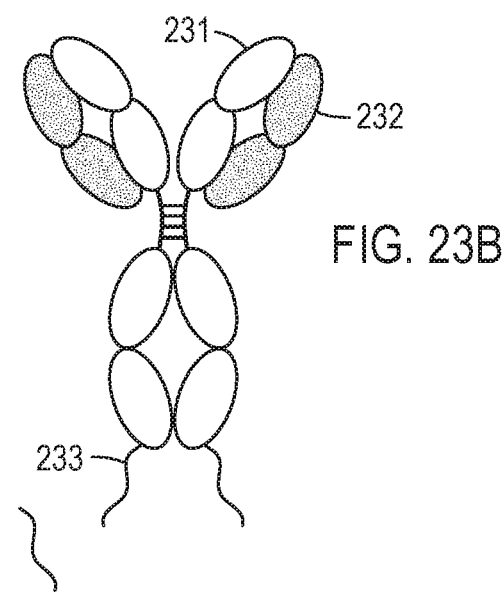
Figure 23C:
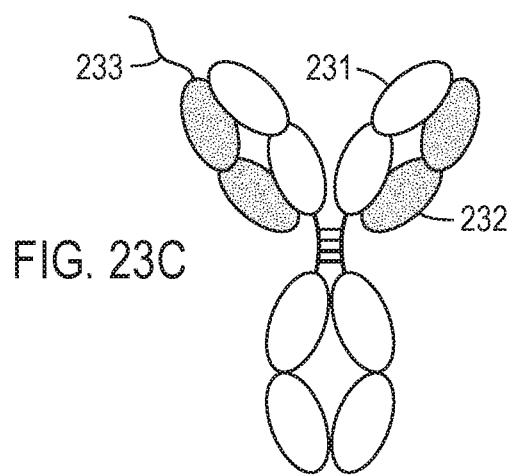
Figure 23D:
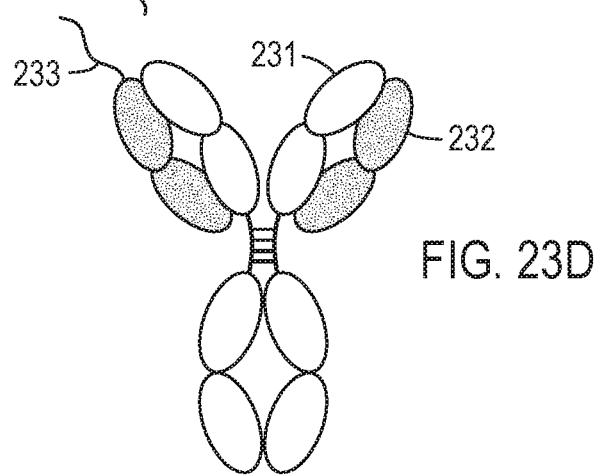
Figure 23E:
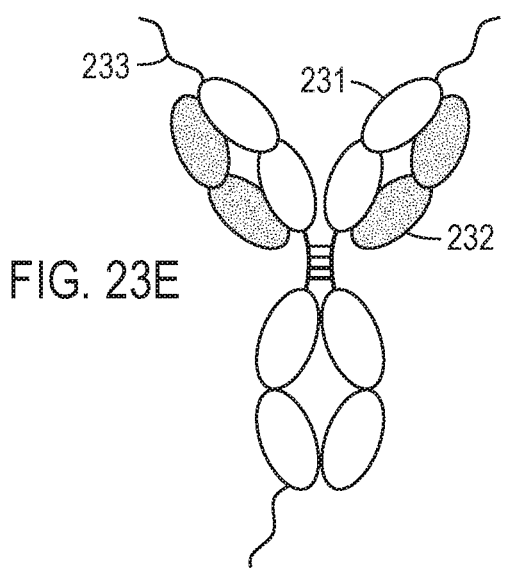
Figure 23F:
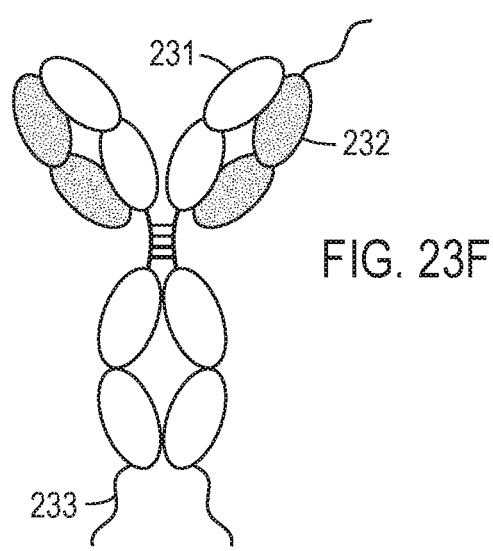

The results are presented in FIG. 18.

Example 22

Production Method

A mammalian cell expression construct was prepared in which the IL-2Rβγc ligand (BGL21) was fused to the C-terminus of a human IgG1 Fc-fragment variant (FP13; SEQ ID NO: 8024). The first cysteine in the hinge region was replaced by a serine to prevent the formation of disulfide bridges and the last amino acid (lysine) was replaced by alanine for fusion stability. An effector silencing mutation was also included in this variant (N297A). A flexible linker (GS)$_{10}$ (SEQ ID NO: 9407) is located between the Fc-fragment and the IL-2Rβγc ligand (BGL21).

Additional mammalian cell expression constructs were prepared in which the IL-2Rβγc ligand (BGL21) was fused to the C-terminus of a human IgG2 Fc-fragment variant in which the first and second cysteines in the hinge region were replaced by serine to prevent the formation of disulfide bridges and the last amino acid (lysine) was replaced by glycine for fusion stability. A flexible linker (GS)$_{10}$ (SEQ ID NO: 9407) (see FP14; SEQ ID NO: 8025) or a rigid linker (PA)$_{10}$ (SEQ ID NO: 9428) (see FP15; SEQ ID NO: 8026) is located between the Fc-fragment and the IL-2Rβγc ligand (BGL21).

Expression plasmids were transfected into CHO-K1 cells and stable pools expressing IL-2Rβγc ligand (BGL21) IgG Fc-fragment fusions were selected in antibiotic containing media. Individual clones were isolated from these pools by limiting dilution and tested for high expression of the IL-2Rβγc ligand (BGL21) IgG Fc-fragment fusion proteins. Large scale cultures of high expressing clones were harvested by centrifugation and the secreted fusion proteins were purified from the supernatants using protein A affinity chromatography. Size exclusion chromatography was used to remove high molecular weight impurities.

Example 23 pH Selective Screening

IL-2Rβ and Rγc ligands were screened with two peptide libraries to identify peptides exhibiting pH-dependent affinity for the receptor subunit. The screening approach utilized cycles of binding and elution under various acidic and neutral pH conditions.

The binding of phage to IL-2Rβ-GPI or Rγc-GPI was determined using phage ELISA at the two target pH values and the percent change in binding at pH 7.4 relative to binding at pH 6.0 was calculated.

For pH-dependent phage titration, the ELISA screening protocol described in the preceding paragraph was used with the following differences: (1) all 96-well ELISA plates contained IL-2Rβ-GPI target; or Rγc-GPI target, and (2) the titration of the phage supernatants was prepared in two different PBT pH buffers; pH 6.0 and pH 7.4.

Phage titration was performed in a 96-well polypropylene plate using the following procedure. A 3-times dilution of phage in PBT pH 6 buffer and pH 7.4 buffer was prepared. One hundred (100) µL of the diluted phage were transferred to the target-coated assay plate and incubated at 4° C. for 1 h.

The pH 6.0 wells were washed 3 times with cold PT pH 6.0 and the pH 7.4 wells were washed 2 times with cold PT pH 7.4.

The bound phage were detected with anti-M13-HRP.

Example 24

ELISA Protocol for Biotinylated Peptide pH-Dependent Binding (IL-2Rβ/Fc-Receptor Binding/Multivalent)

For each peptide to be assayed, sixteen (16) ELISA plate wells were coated with neutravidin (10 µg/mL in PBS pH 7.2) at 50 µL/well. The coated wells were incubated at 25° C. for at least 1 h.

The neutravidin was removed from each well. Three hundred (300) μL of blocking buffer (1×PBS pH 7.2, 1% BSA) was added to each well of the neutravidin-coated plates. All plates were covered and maintained at 25° C. for 1 h or overnight at 4° C.

The incubated plates were washed 4 times with PT (1×PBS pH 7.2, 0.05% Tween®20) buffer.

The biotinylated peptides were diluted to 1 μM in PBT pH 7.2 buffer and 50 μL was added to the appropriate 16 wells (8 for each binding pH). The plates were incubated at 25° C. for at least 1 h.

Two (2) titrations of IL-2Rβ-Fc protein were prepared in a polypropylene plate starting at 2 μg/mL using PBT pH 6.0 and pH 7.4 and diluting 3-fold.

The plates were washed 4-times with PT (1×PBS pH 7.2, 0.05% Tween®20) buffer.

Fifty (50) μL of the IL-2Rβ-Fc protein dilutions were added to the assay plates buffered at pH 6.0 or pH 7.4) and incubated for 1 h at 4° C.

The incubated plates were washed 3-times with the corresponding pH buffer PT (50 mM PBS pH 6.0, 0.05% Tween®20 or 50 mM PBS pH 7.4, 0.05% Tween®20).

Fifty (50) μL of goat anti-huIgG-HRP diluted 1:2500 in cold PBT pH 6.0 was added to each well. The plates were then incubated for 1 h at 4° C. The plates were then washed 4 times with cold buffer PT pH 6.0. Fifty (50) μL of TMB was then added to each well, and the wells were incubated for 1-10 min at 25° C. Fifty (50) μL of a "stop" solution was added to each well, and the plates were read at 450 nm.

Example 25

STAT5 Phosphorylation in NK-92 Cells with IL-2Rβγc Ligands Having a pH-Biased IL-2Rβ Ligand The IL-2R agonist activity of a pH-biased IL-2Rβγc ligand comprising an IL-2Rβ ligand with a pH-biased affinity for IL-2Rβ was evaluated using a STAT5 phosphorylation assay in NK-92 cells.

The IL-2Rβγc ligand was incubated with NK-92 cells and STAT5 phosphorylation measured as a function of concentration using the methods described in Example 4 where the starvation media was adjusted to either pH 6.0 or pH 7.4.

Figure 24:
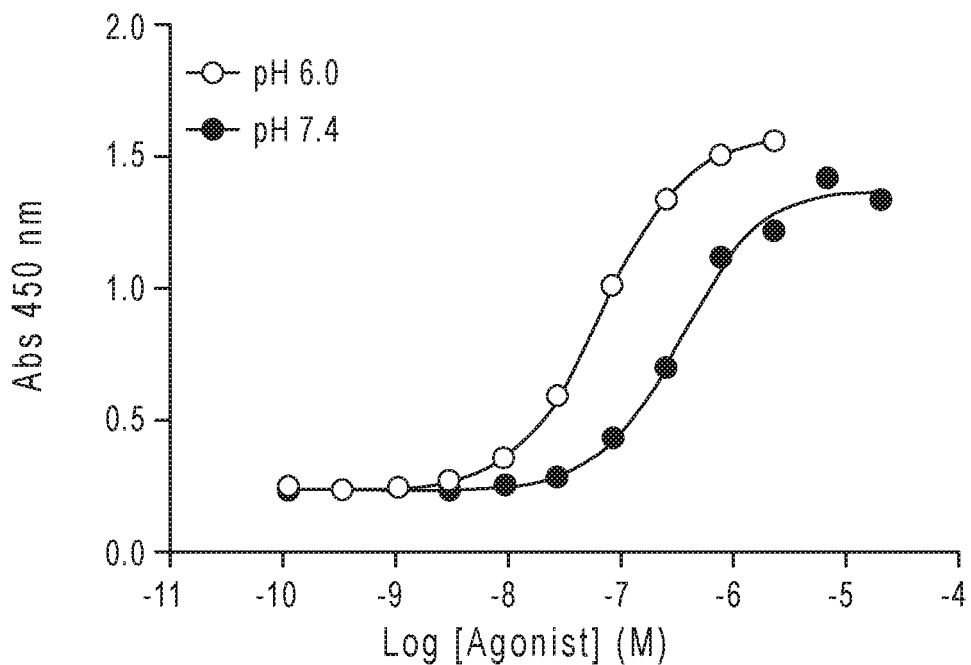
FIG. 24 shows the STAT5 phosphorylation in NK-92 cells following exposure to a pH-biased IL-2Rβγc ligand at pH 6.0 and at pH 7.5.

The results are presented in FIG. 24.

Example 26

Competition ELISA Protocol for IL-2Rβ Ligand pH-Biased Binding

For each peptide to be assayed, sixteen (16) ELISA plate wells were coated with IL-2Rβ-Fc (50 ng/well) for at least 1 h at 25° C. or overnight at 4° C.

The IL-2Rβ-Fc was removed from each well. Three hundred (300) μL of blocking buffer (1×PBS pH 7.2, 1% BSA) was added to each well of the IL-2Rβ-Fc-coated plates. All plates were covered and maintained at 25° C. for at least 1 h.

The incubated plates were washed 3-times with PT (1×PBS pH 7.2, 0.05% Tween®20) buffer.

A pH-biased IL-2Rβγc ligand having a pH-biased IL-2Rβ ligand was diluted to 2-times final concentration (20 μM) in PBT pH 6.0 and pH 7.2 buffer and 50 μL was added to the appropriate 16 wells (8 for each binding pH). The plates were then incubated at 4° C. for 1 h.

A biotinylated version of a peptide ligand that is competitive with the test peptide an in which the binding affinity is the same at pH 6.0 and 7.4, was combined with a neutravidin-HRP conjugate for at least 45 min to prepare the peptide-HRP complex, which was then diluted in pH 6.0 or pH 7.4 PBT.

Without washing, fifty (50) μL of the peptide-HRP complex dilutions were added to the assay plates buffered at pH 6.0 or pH 7.4 and incubated for 1 h at 4° C.

The incubated plates were washed 3-times with the corresponding pH buffer PT (50 mM PBS pH 6.0, 0.05% Tween®20 or 50 mM PBS pH 7.4, 0.05% Tween®20).

Figure 25:
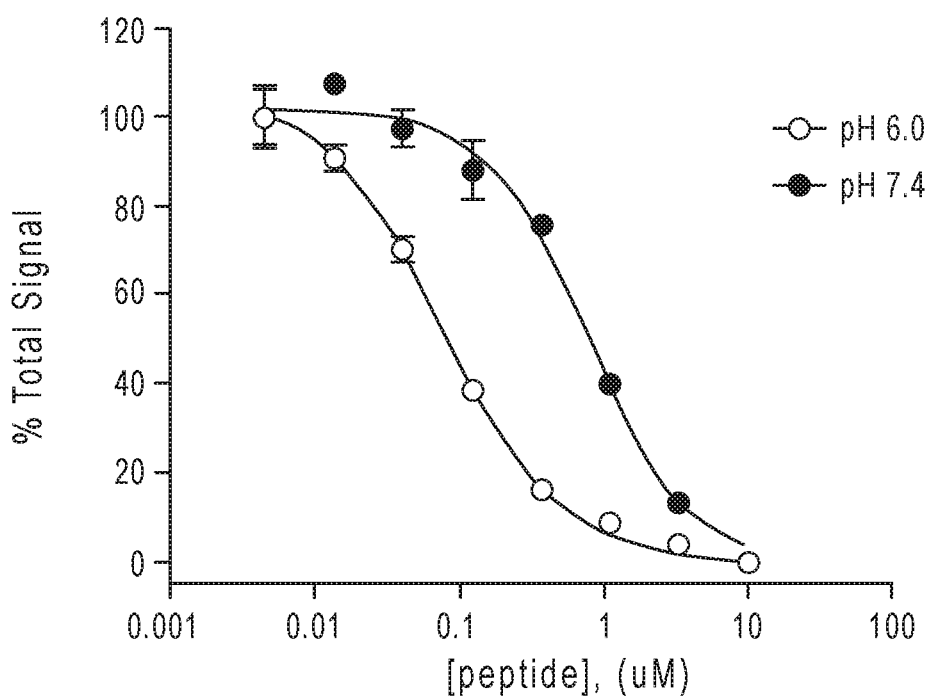
FIG. 25 shows the normalized ELISA signal for competitive binding of a pH-biased IL-2Rβγc ligand at pH 6.0 and pH 7.4 to the IL-2Rβ subunit.

Fifty (50) μL of TMB (3,3'5,5'-tetramethylbensidine) was then added to each well, and the wells were incubated for from 1 to 15 min at 25° C. Fifty (50) μL of a stop solution was added to each well, and the plates were read at 450 nm. The results are presented in FIG. 25.

Example 27

Chemical Synthesis of IL-7Rα Ligands and Rγc Ligands

2-Cholorotrityl resin (1 g, 1.5 mmole/g, from Anaspec) was washed with DMF (2×), and then allowed to stand in 50 mL DMF for 10 min. The swollen resin was treated with an activated solution of Fmoc-glycine prepared from 5 eq. of amino acid and 5 eq. of HATU dissolved at 0.5M in DMF, followed by the addition of 10 eq. of DIEA, and the mixture gently stirred for 30 min at 25° C. The resin was washed (DMF, THF, DCM, and MeOH) and dried to yield the Fmoc-protected resin. Fmoc groups were then removed by gently shaking the resin with 30% piperidine in DMF for 20 min, followed by washing (DMF, THF, DCM, and MeOH), and drying. The resin was then subjected to repeated cycles of Fmoc-amino acid couplings with HATU activation and Fmoc removal with piperidine to build a desired amino acid sequence. Except for examples with four cysteine residues in the sequence, standard 95% TFA-labile amino acid side-chain protecting groups were used. With compounds with four cysteines, for the two cysteine residues proximal to the resin, Trt protection was used, and for the two cysteine residues distal to the resin, Acm protection was used. After Fmoc removal from the final amino acid of the dimer sequence, in some cases the terminal amine groups were acylated with acetic anhydride (10 eq.) and DIEA (20 eq.) in DMF for 20 min, followed by washing as described above. The completed peptide was cleaved from the resin by suspension in a solution of TFA (95 vol %), water (2.5 vol %), and triisopropylsilane (2.5 vol %) for 3 h at 25° C. The TFA solution was cooled to 5° C. and poured into Et$_2$O to precipitate the peptide. Filtration and drying under reduced pressure gave the desired peptide. Purification via preparative HPLC with a C18 column afforded the pure peptide with the two C-terminal thiol groups in a reduced state. This peptide was dissolved in 20% DMSO/water (1 mg dry weight peptide/mL) and allowed to stand at 25° C. for 36 h, and then purified by reverse phase HPLC to provide the peptide with the two C-terminal thiols linked by a disulfide bridge. In compounds containing four cysteines, the two N-terminal Acm-protected cysteine residues were then deprotected by dissolving 0.1 mmole of peptide in 25 mL of 50% acetic acid/H$_2$O and 2.5 mL of 1M HCl and adding 5 mL of 0.1M iodine (in glacial acetic acid; 5 eq.) dropwise with stirring under a nitrogen atmosphere. The deprotection/oxidation reaction was allowed to proceed for 2 h at 25° C. with frequent monitoring (analytical HPLC) to ensure complete reaction. The reaction was stopped by addition of ice-cooled diethyl ether (9 volume eq.). The resulting solution was cooled on dry ice (3 min), the ether solution carefully decanted, and the resulting light-yellow solid purified by preparative reverse phase HPLC (95%) to yield the final peptide dimer having an IL-7Rα and an Rγc ligand.

Example 28

Synthesis of IL-7Rαγc Ligands Using Click Chemistry

The peptide sequences of IL-7Rα ligand and Rγc ligands were synthesized separately using standard solid phase synthesis conditions and Fmoc-protected amino acids as described in Example 27.

Rink amide-MBHA resin (1 g, 1.5 mmole/g, Anaspec) was washed with DMF (2×), and then allowed to stand in 50 mL DMF for 10 min. Separate portions of the swollen resin were treated with either an activated solution of Fmoc-propargyl glycine (IL-7Rα ligand) or 2-(Fmoc-NH)-5-azido-pentanoic acid (Rγc ligand) prepared from 5 eq. of amino acid and 5 eq. of HATU dissolved at 0.5M in DMF, followed by the addition of 10 eq. of DIEA, and the mixture was gently stirred for 30 min at 25° C. The resin was washed (DMF, THF, DCM, and MeOH) and dried to yield the Fmoc-protected resin. Fmoc groups were then removed by gently shaking the resin in 30% piperidine in DMF for 20 min, followed by washing (DMF, THF, DCM, and MeOH), and drying. The resin was then subjected to repeated cycles of Fmoc-amino acid couplings with HATU activation and Fmoc removal with piperidine to provide a desired Rγc ligand amino acid sequence and a desired IL-7Rα ligand amino acid sequence. Standard 95% TFA-labile amino acid sidechain protecting groups were used for all residues. After Fmoc removal from the final amino acid of each ligand sequence, the terminal amine groups were acylated with acetic anhydride (10 eq.) and DIEA (20 eq.) in DMF for 20 min.

Each completed ligand was cleaved from the resin by suspension in a solution of TFA (95%), water (2.5%), and triisopropylsilane (2.5%) for 3 h at 25° C. The TFA solution was cooled to 5° C. and poured into $Et_2O$ to precipitate the peptide. Filtration and drying under reduced pressure gave the desired ligands. Purification via preparative HPLC with a C18 column afforded the pure peptides with the two thiol groups in a reduced state. The ligands were separately dissolved in 20% DMSO/water (1 mg dry weight peptide/mL), allowed to stand at 25° C. for 36 h, and then purified by reverse phase HPLC to provide the IL-7Rα and Rγc ligands with the two thiols linked via an intramolecular disulfide bridge.

Two-tenths (0.2) mL of a 2.0 mM solution of purified alkyne-containing IL-7Rα ligand was prepared by dissolving the ligand in 1:1 $H_2O$/tBuOH. Similarly, 0.2 mL of a 2.4 mM solution of the purified azide-containing ligand was prepared using the same solvent. The two ligand solutions along with 0.1 mL of 100 mM $CuSO_4$ in $H_2O$, 0.1 mL of 250 mM of a Cu(I) chelating agent such as DIEPA, pyridine, or THPTA (tris(3-hydroxypropyltriazolylmethyl)amine), in 3:1 DMSO/tBuOH, 0.1 mL of 0.5 M ascorbic acid in $H_2O$, and 0.3 mL of 3:2 tBuOH/$H_2O$ were combined, and the reaction allowed to proceed at 45° C. under anaerobic conditions. Reaction progress was monitored frequently by LC/MS, and additional azide-containing ligand and $CuSO_4$ were added to drive the reaction to completion. After the maximal amount of alkyne was consumed (approx. 3 h), the reaction was quenched by addition of approx. 8 mL of 1:1 $H_2O$/ACN, and the peptide dimer purified (95%) using a preparative-scale C18 HPLC column.

The structures of synthetic heterodimers comprising an IL-7Rα ligand and an Rγc ligand are shown in FIG. 38. The structures of the termini of the IL-7Rα and Rγc ligands and the structure of the linkers for the heterodimers is shown in Tables 1-3. Refer to Tables 1-3 for the structures of the linkers, the alkynyl terminal groups, and the azide terminal groups. The SEQ ID NOS: refer to the amino acid sequence without flanking amino acids.

Example 29

STAT5 Phosphorylation in TF-1-7α Cells with IL-7Rαγc Ligands Having Different Ligand Attachment Orientations IL-7Rαγc ligands were evaluated for induction of STAT5 phosphorylation in TF-1-7Rα cells. TF-1-7Rα cells were derived from the growth factor-dependent human erythroleukemia cell line TF-1 (ATCC No. CRL-2003), which naturally express common γc receptors (Rγc) but not IL-7Rα. The cells were engineered to be IL-7 responsive by transfection with human full-length IL-7Rα. A cell line expressing higher levels of IL-7Rα was selected by growth in IL-7, and both IL-7Rα and Rγc subunit expression levels were verified by qPCR analysis.

To test compounds for induction of STAT5 phosphorylation TF-17Rα cells were starved overnight at $5 \times 10^5$ cells/mL in starvation medium (RPMI 1640+2.5 µg/L glucose+5% FBS+2 mM L-glutamine+1 mM NaPyr+10 mM HEPES with no GM-CSF or rhIL-7 supplement) in T75 flasks. The following day, cells were plated in 96-well V-bottom plates at $2 \times 10^5$ cells/well. Three-fold serial dilutions of IL-7Rα/Rγc ligands or IL-7 in starvation media were added to the cells and incubated for 30 min at 37° C. Cell extracts were prepared by adding a mixture of 10× Cell Lysis Buffer (Cell Signaling Technology No. 9803) and 1×HALT Phosphatase and Protease Inhibitor Cocktail (Thermo Fisher #78442) directly to the wells. The plates were agitated at 25° C. for 5 min to prepare cell extracts for immediate use or stored at −80° C. Detection of pSTAT5 was performed using a PathScan® Phospho-Stat5 (Tyr694) Sandwich ELISA Kit (Cell Signaling Technology No. 7113). Cell extracts were added to microwells that were pre-coated with a mouse anti-phospho-STAT5 antibody and incubated overnight at 4° C. Wells were then washed with PBS and bound phospho-STAT5 (Tyr694) was detected by adding a rabbit anti-STAT5 detection antibody and incubating for 1 h at 37° C. Wells were washed with PBS and an anti-rabbit IgG HRP-linked antibody was added to each well. After a final wash TMB substrate solution was added to measure the amount of HRP in each well. Absorbance at 450 nm was read in a microplate reader. The signal that was produced is proportional to the quantity of phosphorylated STAT5 in each cell extract.

Figure 27:
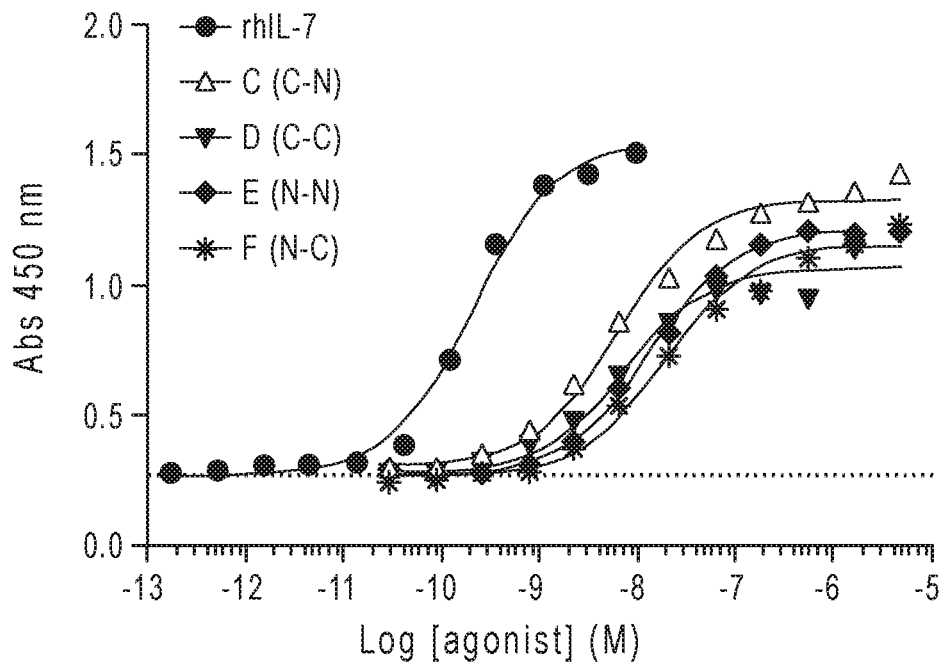
FIG. 27 shows STAT5 phosphorylation in TF-1-7α cells exposed to rhIL-7 or to IL-7Rαγc ligands having various attachment orientations of the respective IL-7Rα ligand and Rγc ligand.

The results are presented in FIG. 27. The structures of the IL-7Rαγc ligands evaluated in FIG. 27 are provided in FIG. 38.

Example 30

Recombinant Fusion Proteins Incorporating an IL-2Rβγc Ligand, an IL-7Rαγc Ligand or an IL-2Rβγc/IL-7Rαγc Dual Binding Compound Mammalian expression vectors were constructed to express an IL-2Rβγc ligand, an IL-7Rαγc ligand or an IL-2Rβγc/IL-7Rαγc dual binding compound linked to full-length human IgG, or to Fc-fragments consisting of the CH2 and CH3 domains of the heavy chain and hinge regions of human IgG2. Each vector included strong constitutive promoter (CMV or hEF1-HTLV) and an IL-2 signal peptide sequence for secretion of the fusion protein into the culture media. Vectors were designed to enable peptide ligands to be fused to either the N- or C-terminus of the immunoglobulin proteins and to incorporate construct linkers of varying lengths between the IL-7Rαγc ligands and IgG. Fusion proteins were transiently expressed in 293 human embryonic kidney cells (FreeStyle® 293-F) by transfecting plasmid DNA into the cells using polyethyleneimine reagent PEI MAX® (Polysciences, Inc.). Transfected cells were grown in FreeStyle® 293 Expression Medium (ThermoFisher) in shaker flasks in a 37° C. humidified $CO_2$ incubator on an orbital shaker rotating at 125 rpm. Cultures were harvested 96 h post-transfection by centrifugation and the secreted fusion proteins were purified from the supernatants using protein A affinity chromatography.

Protein A agarose resin was mixed with culture supernatant and incubated at room temperature for several hours. The resin was then washed three times with PBS and bound IgG IL-7Rα/Rγc ligand fusion was eluted with 0.1 M glycine buffer (pH 2.8). Eluates were neutralized with 1M Tris buffer and quantified by measuring absorbance at 280 nm using a NanoDrop® spectrophotometer. Protein concentrations were determined using calculated extinction coefficients derived from the primary sequence of the protein. Size exclusion chromatography was used to remove high molecular weight impurities prior to measuring the activities of the fusion proteins in bioassays.

Amino acid sequences of IL-7Rαγc ligand fusion proteins used in the experimental examples are provided in FIGS. 39A-39D. The hIgG2 Fc-fragment refers to the Fc region consisting of the CH2 and CH3 domains of the IgG2 heavy chain and the hinge region. The first and second cysteines of the hinge region were replaced with serine to prevent detrimental disulfide bridges. The last amino acid (lysine) of the Fc region was replaced with an alanine for fusion stability. The N-terminus of IgG2 Fc-fusion constructs may include Ala-Pro-Leu (derived from InvivoGen vector).

Amino acid sequences of IL-2R γc ligand fusion proteins used in the experimental examples are provided in FIGS. 20A-20J.

Example 31

STAT5 Phosphorylation in TF-17Rα Cells and PBMCs with IL-7Rαγc Ligands

The agonist activity of IL-7Rαγc ligands comprising synthetic peptide heterodimers and Fc-fusion proteins was evaluated in STAT5 phosphorylation assays in TF-1-7Rα cells and primary human peripheral blood mononuclear cells (PBMCs). Compounds were incubated with cells and STAT5 phosphorylation was measured as a function of concentration using the methods described in Example 4. Results are presented in FIGS. 28 and 29, respectively.

Figure 28:
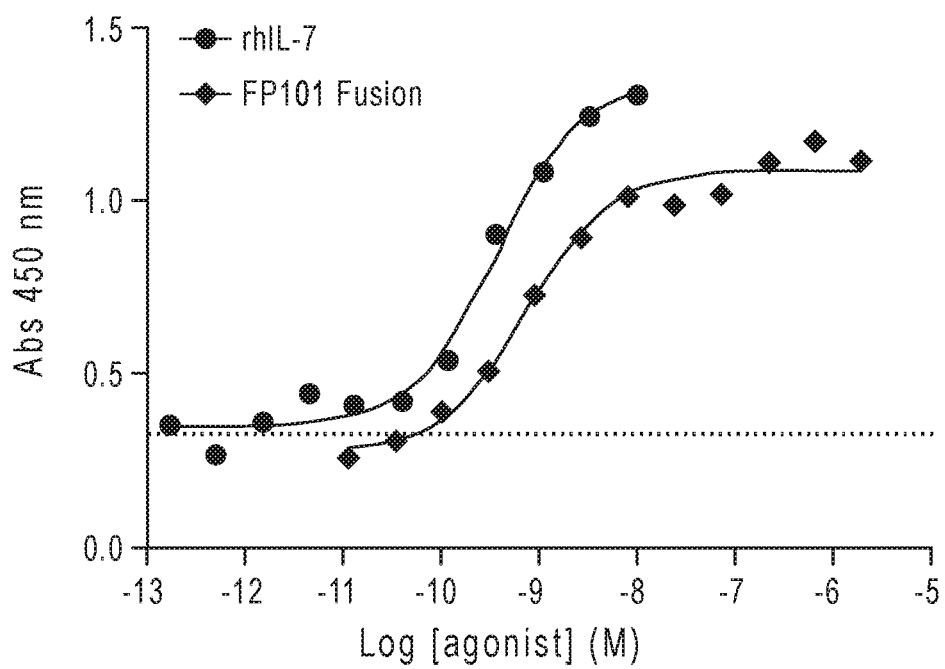
FIG. 28 shows STAT5 phosphorylation in TF-1-7α cells exposed to rhIL-7 and to an Fc-IL-7Rαγc ligand fusion construct.
Figure 29:
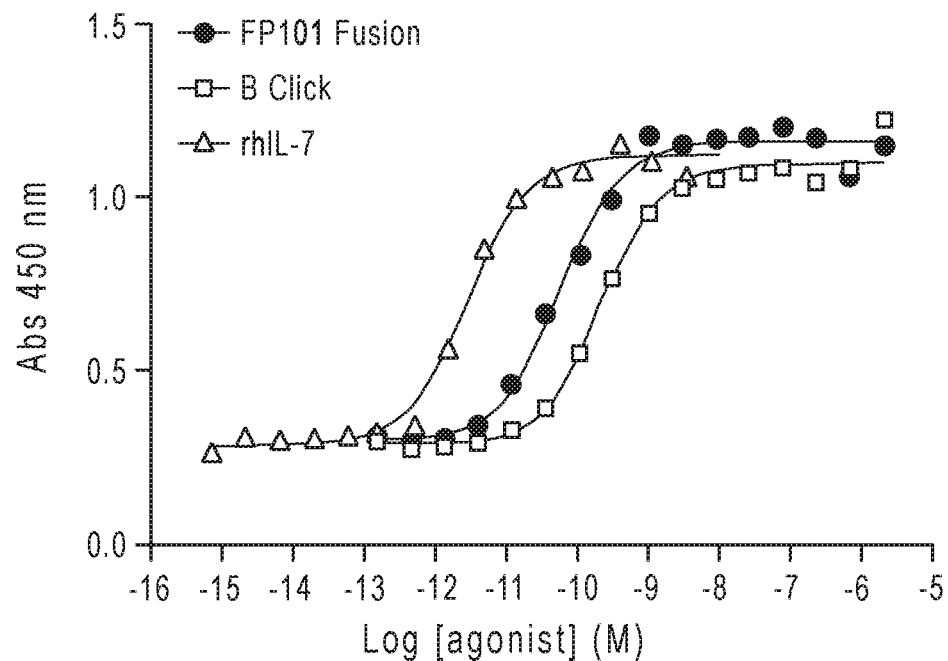
FIG. 29 shows STAT5 phosphorylation in resting human PBMC cells exposed to rhIL-7, a synthetic IL-7Rαγc ligand, or an Fc-IL-7Rαγc ligand fusion construct.

The structures of the IL-7Rαγc ligand and IL-7Rαγc fusion construct evaluated in FIGS. 28 and 29 are provided in FIGS. 38 and 39.

The agonist activity of IL-7Rαγc ligands comprising synthetic peptide heterodimers and Fc-fusion proteins was evaluated in STAT5 phosphorylation assays in cynomolgus peripheral blood mononuclear cells (PBMCs). Compounds were incubated with cells and STAT5 phosphorylation was measured as a function of concentration using the methods described in Example 4. Results are presented in FIG. 57.

Figure 57:
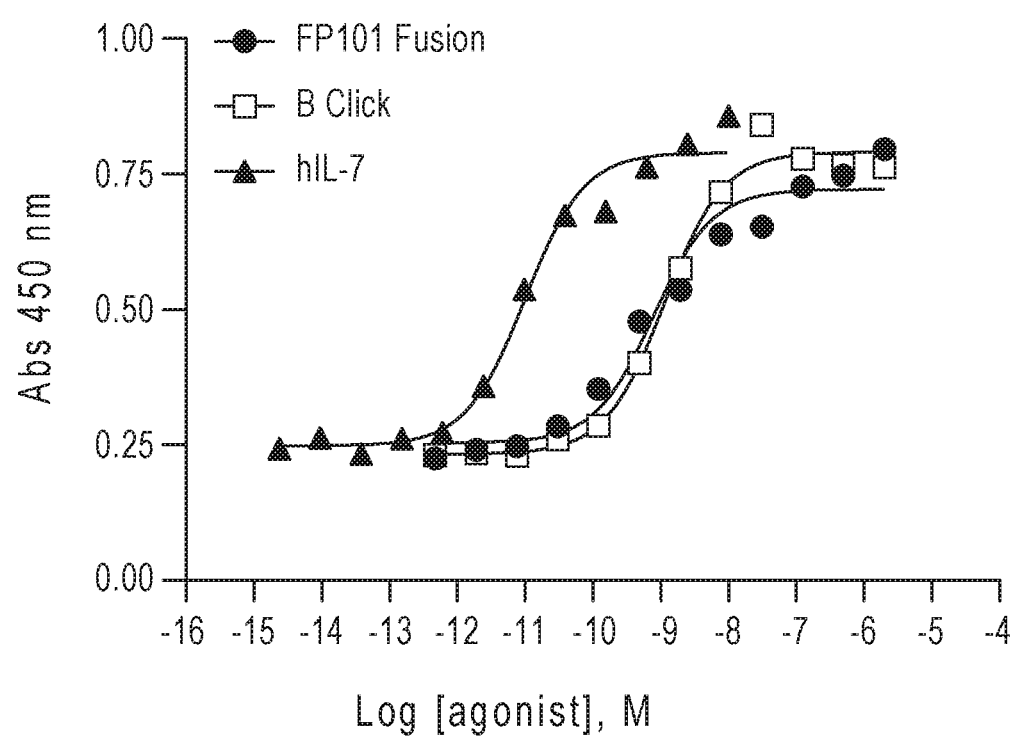
FIG. 57 shows STAT5 phosphorylation in resting cyno PBMC cells exposed to IL-7, a synthetic IL-7Rαγc ligand, or an Fc-IL-7Rαγc ligand fusion construct.

The structures of the IL-7Rαγc ligand and IL-7Rαγc fusion construct evaluated in FIG. 57 are provided in FIGS. 38 and 39.

Example 32

Proliferation of CD4+ and CD8+ Cells from Human PBMCs with IL-7Rαγc Ligands

Human PBMCs were isolated from a buffy coat by density gradient centrifugation (Lymphoprep®, Stemcell Technologies #07811) and cultured overnight in T-cell medium (CTS OpTmizer®, ThermoFisher No. A1048501) at $3 \times 10^6$ cells/mL in a T75 flask. The following day, the cells were resuspended in fresh medium and plated at $5 \times 10^5$ cells/well in a 96-well cell culture plate. Three-fold serial dilutions of either IL-7 or an IL-7Rα ligand were added to the cells and incubated for 4 days at 37° C. After the treatment, the cells were incubated in viability dye (Live/Dead® Fixable Aqua Cell Stain Kit, ThermoFisher #L34965) for 30 min at 37° C., after which surface antibody staining was then performed in PBS+2% FBS for 30 min on ice. Cells were fixed and permeabilized with Fixation/Permeabilization Buffer (eBioscience Foxp3/Transcription Staining Buffer Set, ThermoFisher #00-5523-00) for 30 min on ice. Intracellular (Ki-67) staining was performed in Permeabilization Buffer for 30 min on ice and the treated cells resuspended in PBS+2% FBS prior to FACS analysis. The CD4 and CD8 T-cell populations were identified as CD3+CD4+CD8− and CD3+CD8+CD4− respectively.

Antibody conjugates used for cell surface and intracellular staining are shown in Table 12.

TABLE 12

| Antibody conjugates used for cell surface and intracellular staining. | | | | | | | | | |
| --- | --- | --- | --- | --- | --- | --- | --- | --- | --- |
| Marker | CD159a | CD25 | CD3 | CD56 | Ki-67 | Live/Dead | CD4 | CD8 | Foxp3 |
| Fluor | APC | AF780 | AF488 | PerCP-eF1710 | BV421 | Aqua | BV650 | BUV737 | PE |
| Clone | Z199 | CD25-4E3 | SP34 | CMSSB | B56 | — | L200 | SK1 | 206D |
| Vendor | Beckman Coulter | Invitrogen | BD | Invitrogen | BD | Invitrogen | BD | BD | BioLegend |
| Cat. No. | A607797 | 47-0257-42 | 557705 | 46-0567-42 | 562899 | L34957 | 563737 | 612754 | 320108 |

Figure 30:
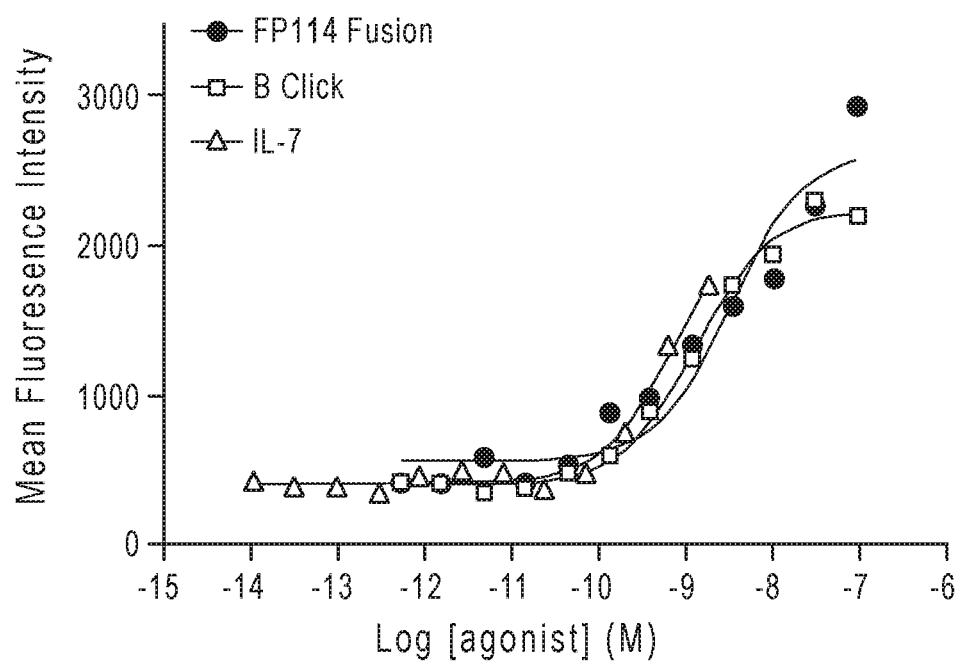
FIG. 30 shows proliferation of human CD-8+ T-cells following exposure to rhIL-7, a synthetic IL-7Rαγc ligand, or an Fc-IL-7Rαγc ligand fusion construct measured by Ki-67 median fluorescence intensity.
Figure 31:
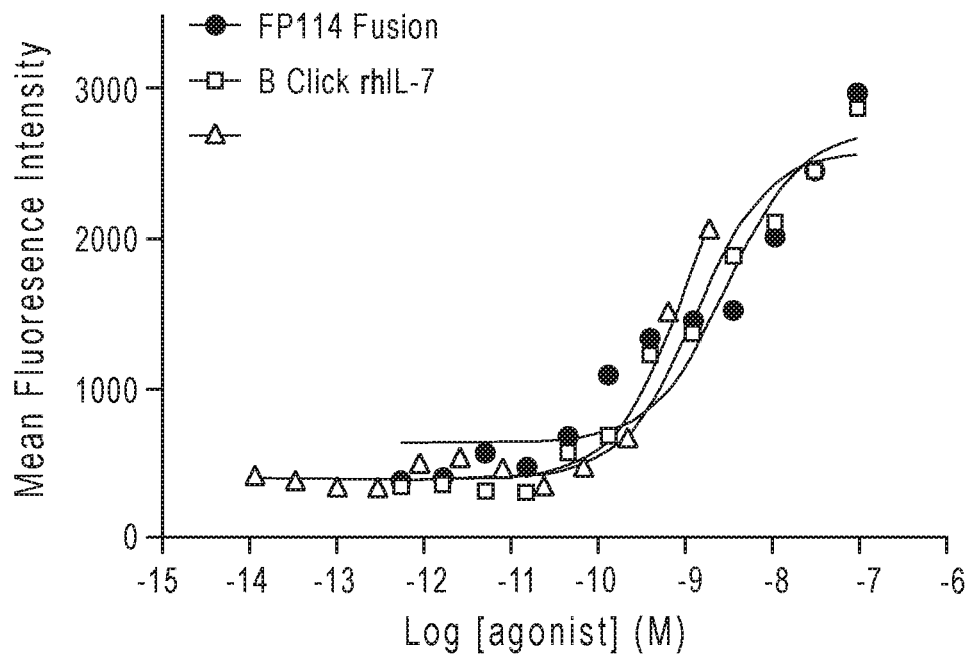
FIG. 31 shows proliferation of human CD-4+ T-cells following exposure to rhIL-7, a synthetic IL-7Rαγc ligand, or an Fc-IL-7Rαγc ligand fusion construct measured by Ki-67 median fluorescence intensity.

IL-7Rαγc ligand B (FIG. 38) and the hIgG2-Fc IL-7Rαγc ligand fusion protein having SEQ ID NO: 8112 (FIG. 39A) exhibited an $EC_{50}$ equivalent to IL-7 as determined using the Ki-67 proliferation assay in CD8+CD4 and CD4+CD8 T-cells. The results are presented in FIGS. 30 and 31, respectively. The structures of the IL-7Rαγc ligand and the IL-7Rαγc fusion construct are provided in FIGS. 38 and 39.

Example 33

Peptide Truncations

The impact of C-terminal and N-terminal amino acid truncations of the IL-7Rα ligand having SEQ ID NO: 2407 on binding to the IL-7Rα subunit was investigated.

Truncated IL-7Rα ligand sequences were synthesized using standard solid phase synthesis conditions and Fmoc-protected amino acids as described in Example 27. A series of peptides were synthesized with Gly-Gly (SEQ ID NO: 9399), Met-Gly-Gly, Gln-Met-Gly-Gly (SEQ ID NO: 9610), or Arg-Gln-Met-Gly-Gly (SEQ ID NO: 9611) omitted from the C-terminus and Val, Val-His, Val-His-Arg, or -Val-His-Arg-Ile (SEQ ID NO: 9612)_omitted from the N-terminus of the IL-7Rα ligand having SEQ ID NO: 2407. The amino acid sequences of the truncated IL-7Rα ligands are shown in Table 13.

TABLE 13

Truncated IL-7Rα ligands based on SEQ ID NO: 2407.

SEQ ID NO: 2407
V H R I P W C T L D P G G L Q C A W L R Q M

SEQ ID NO: 9320
V H R I P W C T L D P G G L Q C A W L R Q M G G

SEQ ID NO: 9321
V H R I P W C T L D P G G L Q C A W L R Q

SEQ ID NO: 9322
V H R I P W C T L D P G G L Q C A W L R

SEQ ID NO: 9323
V H R I P W C T L D P G G L Q C A W L

SEQ ID NO: 9324
V H R I P W C T L D P G G L Q C A W

SEQ ID NO: 9325
V H R I P W C T L D P G G L Q C A

SEQ ID NO: 9326
V H R I P W C T L D P G G L Q C

SEQ ID NO: 9327
H R I P W C T L D P G G L Q C A W L R Q M G G

SEQ ID NO: 9328
R I P W C T L D P G G L Q C A W L R Q M G G

SEQ ID NO: 9329
I P W C T L D P G G L Q C A W L R Q M G G

SEQ ID NO: 9330
P W C T L D P G G L Q C A W L R Q M G G

SEQ ID NO: 9331
W C T L D P G G L Q C A W L R Q M G G

SEQ ID NO: 9332
C T L D P G G L Q C A W L R Q M G G

Binding of the synthetic IL-7Rα peptide ligands to IL-7Rα was evaluated using a competition binding ELISA. Microtiter plate wells were coated with IL-7Rα-Fc (CD127 protein, Fc tag; ECD 21-236; ACRObiosystems, Inc, Cat. No. ILA-H5258) at 1 µg/mL; 50 µL per well in PBS for at least 1 h. The plate was washed once with wash buffer (200 µL, PBS containing 0.05% Tween®-20 (Sigma). Wells were blocked with blocking buffer (PBS containing 1% BSA (BSA Fraction V; VWR Cat. No. 97061-416) for 1 h. A serial dilution of peptides was prepared, at twice the final concentration, in assay buffer (PBS containing 0.5% BSA and 0.05% Tween®-20) in a 96-well polypropylene plate. A terminal biotinylated form of the reference IL-7Rα peptide ligand having SEQ ID NO: 9320 was used to make a precomplex with NeutrAvidin-HRP (NA-HRP; ThermoFisher No. 31030) (Precomplex referred to as bnPeptide::NA-HRP). The bnPeptide::NA-HRP precomplex was prepared by mixing 1.5 µL 100 µM biotinylated peptide, 2 µL NA-HRP and 11.5 PBS and incubated at 4° C. for at least 45 min. After blocking the wells, the plate was washed with a plate washer and serial dilutions of the peptides were added (50 µL/well) and the plate was incubated at 4° C. for 1 h on a plate shaker. The bnPeptide:NA-HRP precomplex was diluted to 40 nM and, without washing, 50 µL was added to each assay well. The plate was returned to 4° C. and incubated for 45 min. The plate was washed using the plate washer and cold wash buffer. Fifty (50) µL of TMB One Component HRP Microwell substrate (TMB; Surmodics No. TMBW-1000-01) was then added to each well, and the wells were incubated for 1-10 min at 25° C. Fifty (50) µL of a solution (Surmodics No. LSTP-0100-0) was then added and the plate read at 450 nm.

The results are shown in FIGS. 32 and 33, with the amino acid sequences of the IL-7Rα peptide ligands denoted in the figures.

Example 34

Alanine Scan

A series of peptides were synthesized where each amino acid residue between the two cysteines was systematically replaced by an alanine residue (Alanine-scan). The peptide sequences were synthesized using standard solid phase synthesis conditions and Fmoc-protected amino acids as described in Example 27. The interaction of the Ala-scan peptides with IL-7Rα was evaluated using a competition binding assay as described in Example 33.

The peptide sequences are provided in Table 14 and the results are presented in Table 15.

TABLE 14

Amino acid sequences for alanine scan.

SEQ ID NO: 9370
G G V V C Q D W E G V E L C W Q G G

SEQ ID NO: 9371
G G V V C A D W E G V E L C W Q G G

SEQ ID NO: 9372
G G V V C Q A W E G V E L C W Q G G

SEQ ID NO: 9373
G G V V C Q D A E G V E L C W Q G G

SEQ ID NO: 9374
G G V V C Q D W A G V E L C W Q G G

SEQ ID NO: 9375
G G V V C Q D W E A V E L C W Q G G

SEQ ID NO: 9376
G G V V C Q D W E G A E L C W Q G G

SEQ ID NO: 9377
G G V V C Q D W E G V A L C W Q G G

SEQ ID NO: 9378
G G V V C Q D W E G V E A C W Q G G

TABLE 15

Binding to Rγc subunit.

| Rγc Ligand | IC$_{50}$ (nM) |
|---|---|
| SEQ ID NO: 9370 | <50 |
| SEQ ID NO: 9371 | <100 |
| SEQ ID NO: 9372 | <50 |
| SEQ ID NO: 9373 | <2000 |
| SEQ ID NO: 9374 | <50 |
| SEQ ID NO: 9375 | <100 |
| SEQ ID NO: 9376 | <2000 |
| SEQ ID NO: 9377 | <50 |
| SEQ ID NO: 9378 | <5000 |

Example 35

Binding Assay with Different IL-7Rα Ligands

A competition binding assay was used to characterize the IL-7Rα binding site of an IL-7Rα ligand having SEQ ID NO: 9320 and an IL-7Rα ligand having SEQ ID NO: 2402. The competition binding ELISA is described in Example 7. In this example, bnPeptide::NA-HRP precomplexes were made using C-terminal biotinylated forms of the IL-7Rα ligands having SEQ ID NO: 9320 and SEQ ID NO: 2402.

Figure 34:
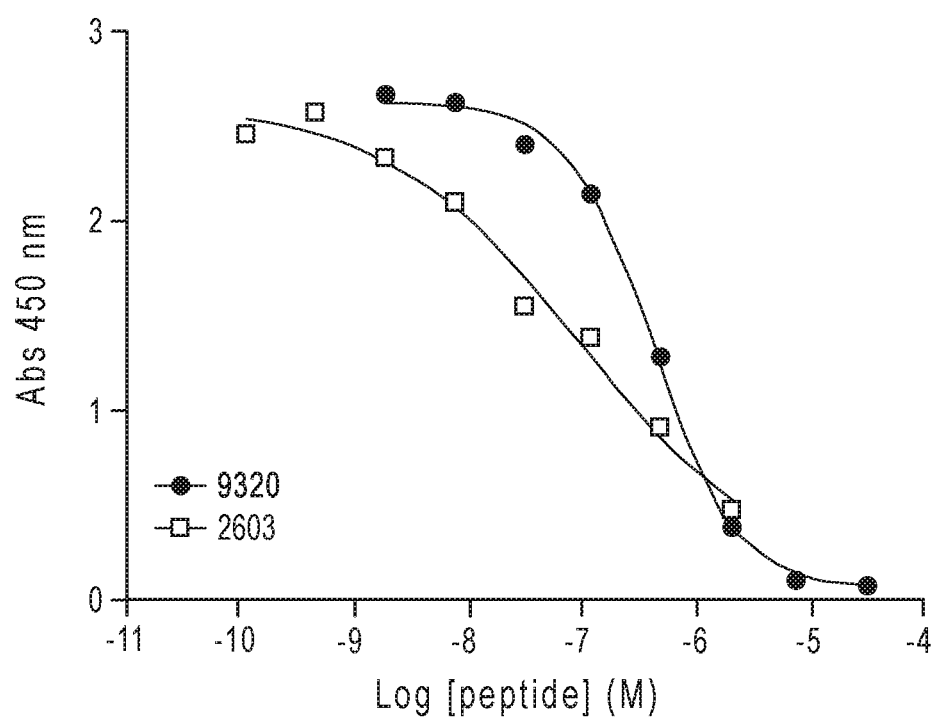
FIG. 34 shows the normalized ELISA signal for competitive binding of an Fc-IL-7Rα ligand fusion construct based on an IL-7Rα having SEQ ID NO: 9320 or SEQ ID NO: 2603 with the corresponding biotinylated IL-7Rα/NA-HRP complex with IL-7Rα having SEQ ID NO: 9320.
Figure 35:
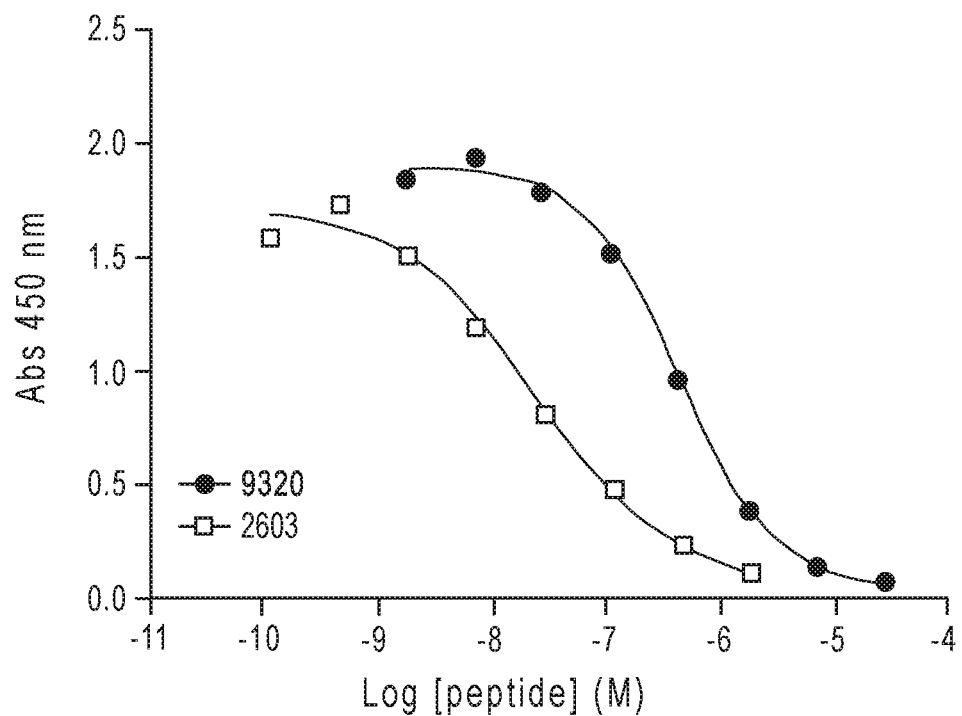
FIG. 35 shows the normalized ELISA signal for competitive binding of an Fc-IL-7Rα ligand fusion construct based on an IL-7Rα having SEQ ID NO: 9320 or SEQ ID NO: 2603 with the corresponding biotinylated IL-7Rα/NA-HRP complex IL-7Rα having SEQ ID NO: 2603.

The results presented in FIG. 34 (bnPeptide::NA-HRP SEQ ID NO: 9320) and FIG. 35 (bnPeptide::NA-HRP SEQ ID NO: 2402) show that the IL-7Rα ligands tested compete with one another and therefore bind to the same functional site on the IL-7Rα subunit.

Example 36

IL-7Rαγc Ligand Construct PK Analysis in CD-1 Mice

A pharmacokinetic study of an IL-7Rαγc ligand construct was performed in CD-1 male mice. An IL-7Rαγc ligand construct (FP114) (SEQ ID NO: 8125) was administered intravenously with a single dose of 1 mg/kg to each mouse (n=10). Blood samples were collected at 0 h (pre-dose), 1, 2, 6, 24, 48, 72 and 96 h post-dosing into serum separator vials. Samples were centrifuged at 10,000×g for 5 min at 4° C. and the serum transferred to a new tube. Samples were frozen and stored at −80° C. prior to testing.

The TF-1-7Rα STAT5 phosphorylation bioassay was used to quantity the amount of (FP114) present in each of the serum samples. Three-fold serial dilutions of each serum sample or a compound reference standard in starvation media were added to the cells and incubated for 30 mins with the cells. Cells extracts were prepared and the quantity of phosphorylated STAT5 was determined as described in Example 29. The (FP114) concentration in each serum sample was calculated using a standard curve generated from the reference standard.

Figure 36:
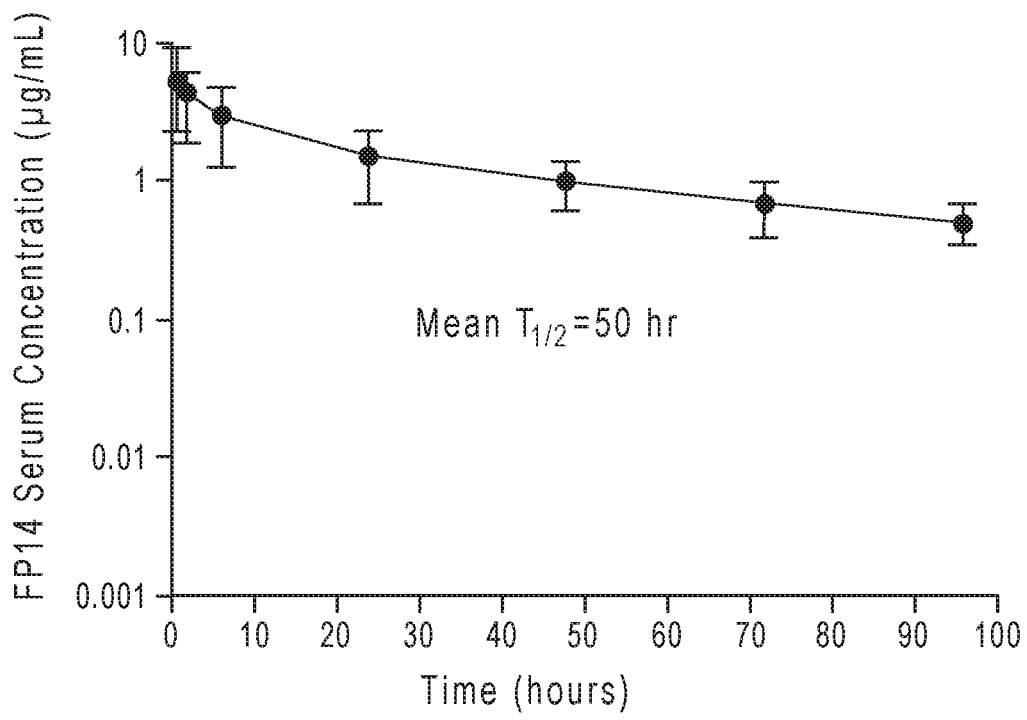
FIG. 36 shows a PK profile of an Fc-IL-7Rαγc ligand fusion construct (FP114, SEQ ID NO: 8125) following administration to mice.

The results are presented in FIG. 36.

Example 37

IL-7Rαγc Ligand Pembrolizumab Fusion Protein

An IL-7Rαγc ligand was fused to the C-terminus of the heavy chain of a therapeutic checkpoint inhibitor antibody that targets PD-1 (Pembrolizumab (FP108) (SEQ ID NO: 8119)) as described in Example 30. The construct was transiently co-expressed with the corresponding light chain construct (SEQ ID NO: 8018) in HEK-293F cells to produce the full IgG IL-7Rα/Rγc ligand fusion protein.

Figure 37:
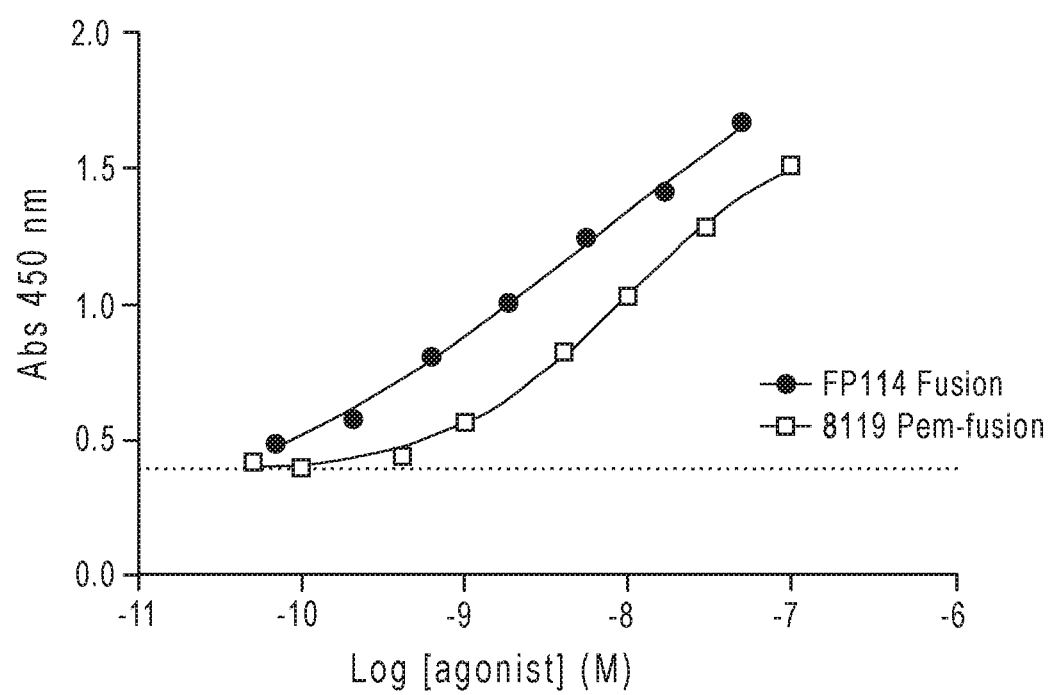
FIG. 37 shows STAT5 phosphorylation in TF-1-7α cells exposed to an Fc-IL-7Rαγc ligand fusion protein (FIG. 14B; SEQ ID NO: 8025), or to an IL-7Rαγc ligand-anti-PD-1 antibody fusion (FIG. 14B; SEQ ID NO: 8019).

Agonist activity of the Pembrolizumab IL-7Rαγc ligand fusion protein was measured in a STAT5 phosphorylation assay with TF-1-7Rα cells using the methods described in Example 29. The results are shown in FIG. 37. The structure of the Pembrolizumab IL-7Rαγc ligand fusion protein is provided in FIG. 39B.

Example 38

Specific IL-2Rβ Binding Site

Competitive binding assays were performed to characterize the binding site for IL-2Rβ ligands on the IL-2Rβ subunit.

Representative phage clones displaying peptides from certain IL-2Rβ ligand families were bound to the extracellular domain (ECD) of the IL-2Rβ subunit immobilized in microtiter wells. Phage binding was conducted in the presence and absence of synthetic test peptides to determine whether the phage-displayed peptides and the test peptides competed for binding to the same site on the IL-2Rβ subunit. Synthetic test peptides were selected to represent IL-2Rβ ligands from different IL-2Rβ ligand families, as well as to provide positive and negative control peptides.

The IL-2Rβ ligand families and the specific IL-2Rβ ligands within those families that were evaluated are provided in Table 16.

TABLE 16

IL-2Rβ ligand families and ligands.

| IL-2Rβ Ligand Family | IL-2Rβ Ligand SEQ ID NO: | Peptide Sequence |
|---|---|---|
| 1 | 154 | Y D C R I A Q V G E L C D L |
| 2A | 180 | N M C L V G D Y W P S C Q I |
| 2A | 182 | Q I C D V G Q W W P D C Q V |
| 2B | 9 | C C Y Q A M V G D L C D F C |
| 2C | 9613[1] | C G M A I G D L C M W T |
| 2C | 209 | R W G D V G D L L M P L |
| 4 | 219 | R S C Y Y K R P R L W C S E |
| Rγc Ligand | 1034 | D C S M W E G V E L C W |

[1]Modified peptide having SEQ ID NO: 1034 with amino acids -W-T-.

The IL-2Rβ ligands bound to the IL-2Rβ subunit with an IC$_{50}$ of less than 10 μM and bound to an irrelevant cytokine receptor subunit such as the IL-2Rγc subunit with an IC$_{50}$ of greater than 100 μM.

Phage binding to the immobilized IL-2Rβ ECD was detected with an antibody against phage coat proteins (anti-phage antibody HRP conjugate) followed by addition of TMB substrate solution and quantified by measuring absorbance in a microtiter plate reader.

The ELISA signal for each phage binding in the presence and absence of the test peptides was compared to determine which synthetic peptides competed with which phage-displayed peptides for binding to the IL-2Rβ subunit. The peptide pairs that exhibited competitive binding (i.e., cross inhibition) were considered to bind at the same functional site on the IL-2 receptor. The results are presented in Table 17.

TABLE 17

Binding of IL-2Rβ ligands to IL-2R.

| | | Phage Clone Peptide SEQ ID NO: | | | | |
|---|---|---|---|---|---|---|
| Peptide SEQ ID NO: | IL-2β Family | 154 1 | 182 2A | 9 2B | 202 2C | 219 4 |
| 154 | 1 | +[1] | + | + | + | − |
| 180 | 2A | + | + | + | + | − |
| 209 | 2C | + | + | + | + | − |
| 219 | 4 | −[2] | − | − | − | + |
| 1034 | Rγc Ligand | − | − | − | − | − |

[1] Peptide competed with phage binding.
[2] Peptide did not compete with phage binding.

The IL-2Rβ ligands did not bind competitively to the binding site of the IL-2R subunit with IL-2. Table 17 shows that IL-2Rβ ligands representing ligand Families 1, 2A, and 2C compete among themselves for binding to the hIL-2Rβ subunit and therefore bind at or near the same site on the hIL-2Rβ subunit.

Example 39

Specific IL-7Rα Binding Site

Competitive binding assays were performed to characterize the binding site for IL-7Rα ligands on the IL-7Rα subunit.

Representative phage clones displaying peptides from certain IL-7Rα ligand families were bound to the extracellular domain (ECD) of the IL-7Rα subunit immobilized in microtiter wells. Phage binding was conducted in the presence and absence of synthetic test peptides to determine whether the phage-displayed peptides and the test peptides competed for binding to the same site on the IL-7Rα subunit. Synthetic test peptides were selected to represent IL-7Rα ligands from different IL-7Rα ligand families, as well as to provide positive and negative control peptides.

The IL-7Rα ligand families and the specific IL-7Rα ligands within those families that were evaluated are provided in Table 18.

TABLE 18

IL-7Rα ligand families and specific IL-7Rα ligands.

| IL-7Rα Ligand Family | IL-7Rα Ligand SEQ ID NO: | Peptide Sequence |
|---|---|---|
| 1 | 2402 | Q C V H W D L D T L F G C I R E Q L E L |
| 1 | 2159 | Q C I H W D I E T L L S C V |
| 2 | 2313 | V P W C T L D P G S L Q C A W F |
| 3A | 2043 | V Y C A E I G E Y R V C R Q |
| 3B | 2104 | Y M A C S S G L S L C R L S |
| N/A | 1204 | V V C Q D W E G V E L C W Q |

The IL-7Rα ligands bound to the hIL-7Rα subunit with an $IC_{50}$ of less than 10 μM and bound to an irrelevant cytokine receptor such as the Rγc subunit with an $IC_{50}$ of greater than 100 μM.

Phage binding to the immobilized IL-7Rα ECD was detected with an antibody against phage coat proteins (anti-phage antibody HRP conjugate) followed by addition of TMB substrate solution and quantified by measuring absorbance in a microtiter plate reader.

The ELISA signal for each phage binding in the presence and absence of the test peptides was compared to determine which synthetic peptides competed with which phage-displayed peptides for binding to the IL-7Rα subunit. The peptide pairs that exhibited competitive binding (i.e., cross inhibition) were considered to bind at the same functional site on the IL-7 receptor. The results are presented in Table 19.

TABLE 19

Competition for IL-7Rα binding to the IL-7Rα subunit among sequence families of IL-7Rα ligands.

| | | Phage Clone SEQ ID NO: IL-7Rα Ligand SEQ ID NO: | | | | |
|---|---|---|---|---|---|---|
| IL-7Rα Ligand SEQ ID NO: | IL-7Rα Ligand Family | 2159 1 | 2313 2 | 2043 3A | 2104 3B | 1204 N/A |
| 2402 | 1 | +[1] | + | + | + | 0[2] |
| 2159 | 1 | | + | + | + | −[3] |
| 2313 | 2 | + | | + | + | − |
| 2043 | 3A | + | + | | + | − |
| 2104 | 3B | + | + | + | | − |
| 1204[4] | N/A | 0 | 0 | 0 | 0 | 0 |

[1] IL-7Rα ligand competed with phage binding.
[2] IL-7Rα ligand did not compete with phage binding.
[3] Not tested.
[4] Negative control.

The IL-7Rα ligands did not bind competitively to the binding site of the IL-7Rα subunit with IL-7.

Table 19 shows that IL-7Rα ligands representing ligand Families 1, 2, 3A, and 3B compete among themselves for binding to the hIL-7Rα subunit and therefore bind at or near the same site on the hIL-7Rα subunit.

Example 40

Specific Rγc Binding Site

Competitive binding assays were performed to characterize Rγc binding site for Rγc ligands, and to IL-7Rαγc ligands.

For Rγc ligands, representative phage clones displaying peptides from Rγc ligand families were bound to the extracellular domain (ECD) of Rγc immobilized in microtiter wells. Phage binding was conducted in the presence and absence of synthetic test peptides to determine if phage peptides and test peptides competed for binding to the same sites on Rγc. Synthetic test peptides were selected to represent peptides from Rγc ligand families, as well as positive and negative control peptides.

A similar study was performed to evaluate the binding Rγc ligands. Rγc ligand family sequences and the specific Rγc ligands evaluated are provided in Table 20.

TABLE 20

Rγc ligand families and ligands.

| Rγc Ligand Family | Rγc Ligand SEQ ID NO: | Peptide Sequence |
|---|---|---|
| 1A | 1011 | K V C E M W G G V L L C W N |
| 1A | 1021 | R T C T E W E N V V L C W V |
| 1B | 1034 | D C S M W E G V E L C W |
| 2 | 1071 | M C W L E W G E W V G S C L |
| 3 | 9614[1] | D L S D L S T F W L S Q |
| 4 | 1109 | C P S M L Q G P E R T W V C |
| 5 | 1128 | S L L K C Y N A S T C A S V F |
| IL-2Rβ Ligand | 154 | Y D C R I A Q V G E L C D L |

[1]Modified ligand having amino acid SEQ ID NO: 248.

The Rγc ligands bound to the Rγc subunit with an $IC_{50}$ of less than 10 μM and bound to the IL-2Rβ subunit with an $IC_{50}$ of greater than 100 μM.

Phage binding to the immobilized Rγc ECD was detected an antibody against phage coat proteins (anti-phage antibody HRP conjugate), followed by addition of TMB substrate solution and quantified by measuring absorbance in a microtiter plate reader.

The ELISA signal for each phage binding in the presence and absence of the test peptides was compared to determine which synthetic peptides competed with which phage peptides for binding to the Rγc subunit. The peptide pairs that exhibited competitive binding (i.e., cross inhibition) were considered to bind at the same functional site on IL-7R.

The results of the competitive binding assay are presented in Table 21.

TABLE 21

Binding of Rγc ligands to the Rγc subunit.

| Rγc Ligand SEQ ID NO: | Rγc Family | Phage Clone Rγc Ligand SEQ ID NO: | | | | | |
|---|---|---|---|---|---|---|---|
| | | 1021 | 1034 | 1071 | 1079 | 1109 | 1128 |
| | | 1A | 1B | 2 | 3 | 4 | 5 |
| 1021 | 1A | +[1] | + | + | + | + | − |
| 1034 | 1B | + | + | + | + | + | − |
| 1071 | 2 | + | + | + | + | + | − |
| 1079 | 3 | + | + | + | + | + | − |
| 1128 | 5 | −[2] | − | − | − | − | + |
| 154 | IL-2Rβ Ligand | − | − | − | − | − | − |

[1]Rγc ligand competes with phage binding.
[2]Rγc ligand does not compete with phage binding.

Example 41

Figure 40B:
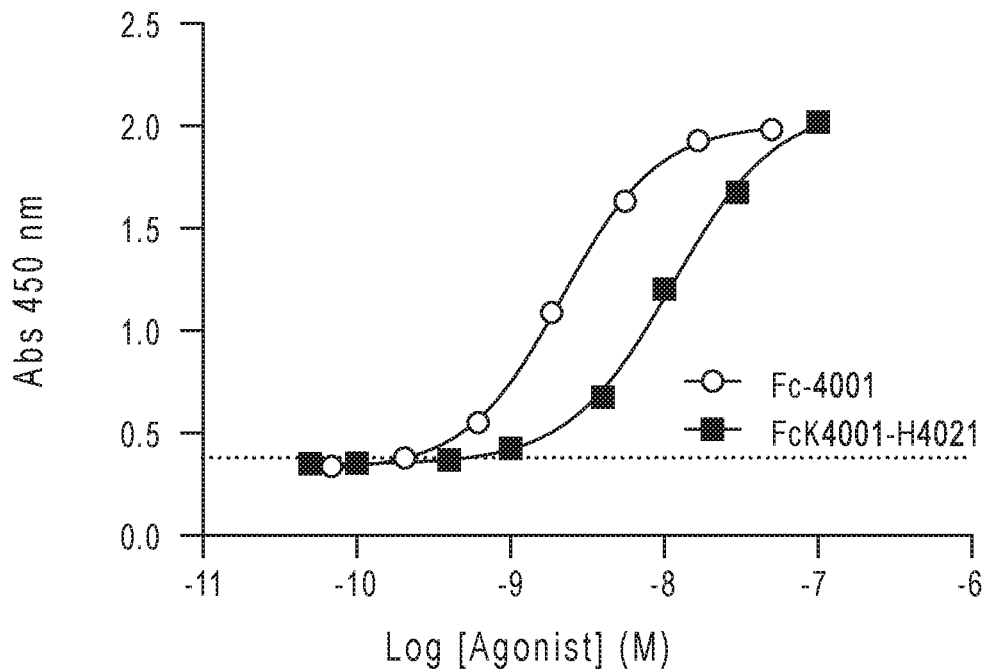
FIG. 40B shows STAT5 phosphorylation in TF-1β cells exposed to either an hIgG1-Fc construct having an IL-2Rβγc ligand bound to the CH3 domain or to an hIgG1-Fc fragment in which an IL-2Rβγc ligand is bound to one CH3 domain and an IL-7Rαγc ligand is bound to the other CH3 domain as shown in FIG. 40A.
Figure 40C:
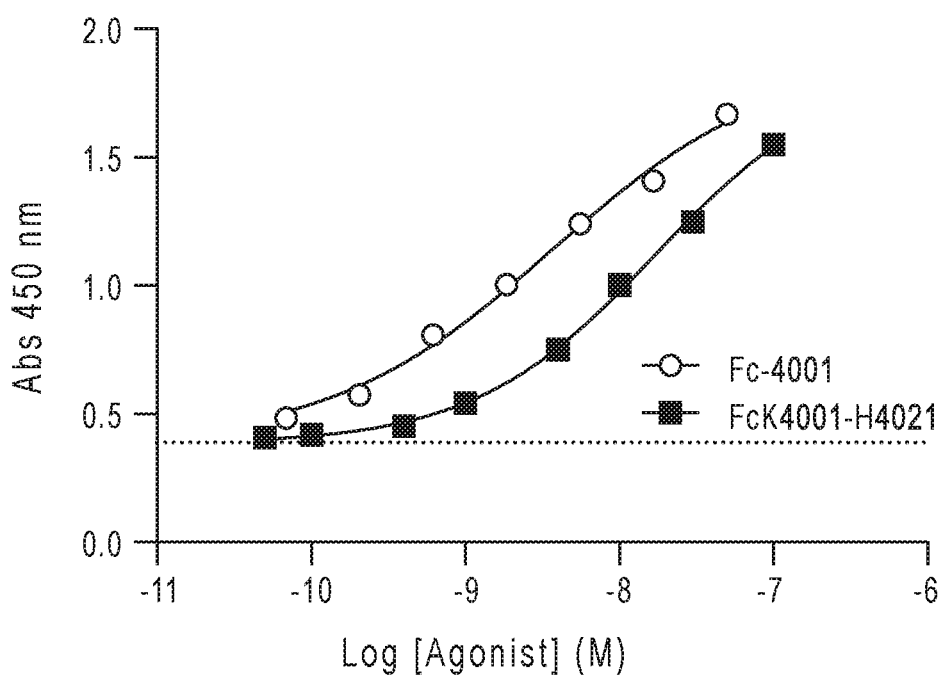
FIG. 40C show STAT5 phosphorylation in TF-1-IL-7Rα cells exposed to exposed either to an hIgG1-Fc construct having an Rγc ligand bound to the CH3 domain or to an hIgG1-Fc fragment in which an IL-2Rβγc ligand is bound to one CH3 domain and an IL-7Rαγc ligand is bound to the other CH3 domain.

STAT5 Phosphorylation in TF-1β and TF-1 IL-7Rα Cells with Dual Receptor Binding Construct The agonist activity in TF-1β and TF-1 IL-7Rα cells of an IL-2Rβγc ligand having SEQ ID NO: 4001 bound to an IgG1-Fc fragment and a dual ligand construct having an IL-2Rβγc ligand having SEQ ID NO: 4001 bound to one CH3 domain of an IgG1 fragment and an IL-7Rαγc ligand having SEQ ID NO: 4021 bound to the other CH3 domain of the IgG1-Fc fragment is shown in FIGS. 40B and 40C, respectively. The structure of the dual ligand construct is shown in FIG. 40A.

Example 42

Figure 41B:
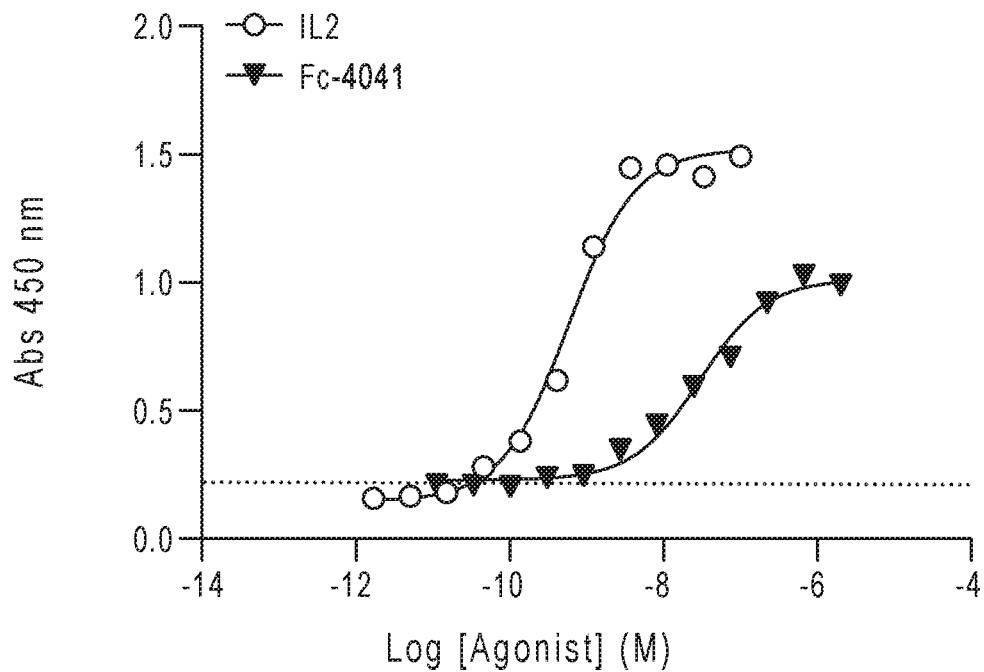
FIG. 41B shows STAT5 phosphorylation in TF-1β cells exposed either to IL-2 or to an hIgG2-Fc fragment construct in which a linear dual receptor ligand is bound to both CH3 domains as shown in FIG. 41A.
Figure 41C:
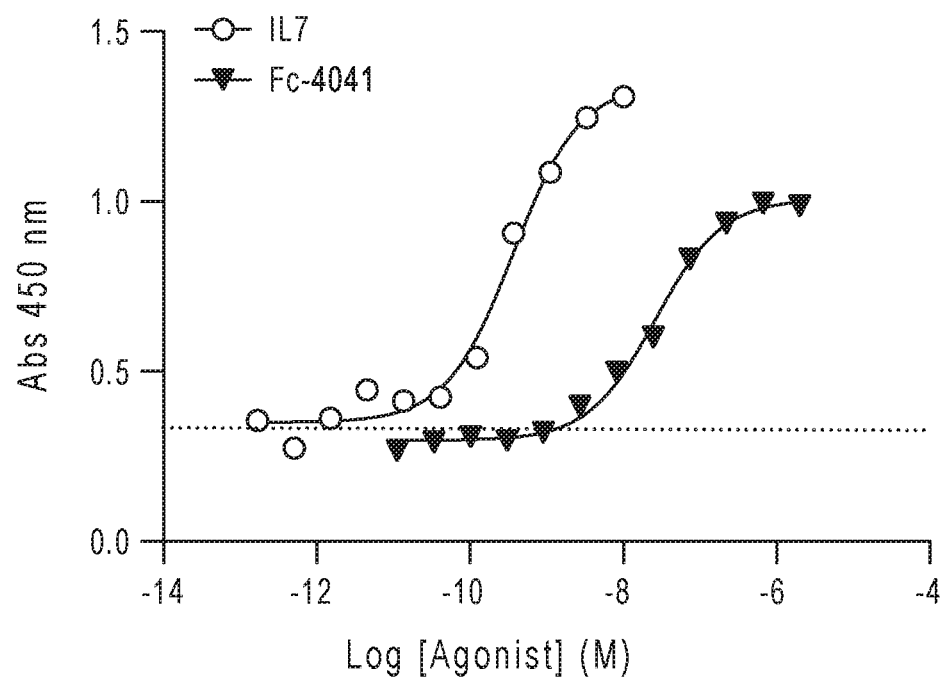
FIG. 41C shows STAT5 phosphorylation in TF-1β-IL-7Rα cells exposed either to IL-7 or to an hIgG1-Fc fragment construct in which a linear dual receptor ligand is bound to both CH3 domains as shown in FIG. 41A.

STAT5 Phosphorylation in TF-1β and TF-1 IL-7Rα Cells with Dual Receptor Binding Construct The agonist activity in TF-1β and TF-1 IL-7Rα cells for IL-2, IL-7, and a dual receptor binding IL-2Rβ/IL-7Rα/Rγc ligand having SEQ ID NO: 4041 bound to both CH3 domains of an IgG2-Fc fragment is shown in FIGS. 41B and 41C, respectively. The structure of the dual receptor binding construct is shown in FIG. 41A.

Example 43

Heterodimeric Fc Fusion

A heterodimeric Fc ligand construct was prepared with an IL-2Rβγc ligand having SEQ ID NO: 4005 bound to the C-terminus of an Fc knob protein and an IL-7Rαγc ligand having SEQ ID NO: 4026 was bound to the C-terminus of an Fc hole protein. Each of the IL-2Rβγc ligand and the IL-7Rαγc ligand were bound to the respective Fc proteins through a construct linker having the structure (GS)$_{10}$ (SEQ ID NO: 9407). The amino acid sequences of the two Fc proteins are provided in Table 22.

TABLE 22

Sequences of Fc-Knob IL-2Rβγc Ligand and Fc-Hole IL-7Rαγc Constructs.

| | |
|---|---|
| SEQ ID NO: 8101 | C-terminal IL-2Rβγc ligand; knob; MW = 31153<br>DKTHTC\*PPC\*PAPEAAGGPSVFLFPPKPKDTLMISRTPE<br>VTCVVVDVSHEDPEVKFNWYVDGVEVHNAKTKPREEQYNS<br>TYRVVSVLTVLHQDWLNGKEYKCKVSNKALPAPIEKTISK<br>AKGQPREPQVYTLPPSREEMTKNQVSLWCLVKGFYPSDIA<br>VEWESNGQPENNYKTTPPVLDSDGSFFLYSKLTVDKSRWQ<br>QGNVFSCSVMHEALHNHYTQKSLSLSPGGSGSGSGSGSGS<br>GSGSGSGSGGWYPCWMAQLGELCDLDGGGSGGVVCQDWE<br>GVELCWQGG |
| SEQ ID NO: 8102 | pC-terminal IL-7Rαγc ligand; hole; MW =31585<br>DKTHTC\*PPC\*PAPEAAGGPSVFLFPPKPKDTLMISRTPE<br>VTCVVVDVSHEDPEVKFNWYVDGVEVHNAKTKPREEQYNS<br>TYRVVSVLTVLHQDWLNGKEYKCKVSNKALPAPIEKTISK<br>AKGQPREPQVYTLPPSREEMTKNQVSLSCAVKGFYPSDIA<br>VEWESNGQPENNYKTTPPVLDSDGSFFLVSKLTVDKSRWQ<br>QGNVFSCSVMHEALHNHYTQKSLSLSPGGSGSGSGSGSGS<br>GSGSGSGSGGVHRIPWCTLDPGGLQCAWLRQMGGGSGGV<br>VCQDWEGVELCWQGG |

The cysteines marked as C* denoted the sites of interchain disulfide bonds between the Knob and Hole Fc proteins. The molecular weight of the Fc-Knob/Hole IL-2Rβγc/IL-7Rαγc heterodimer SEQ ID NOS: 8001 and 8002) was 62,738.

Figure 42A:
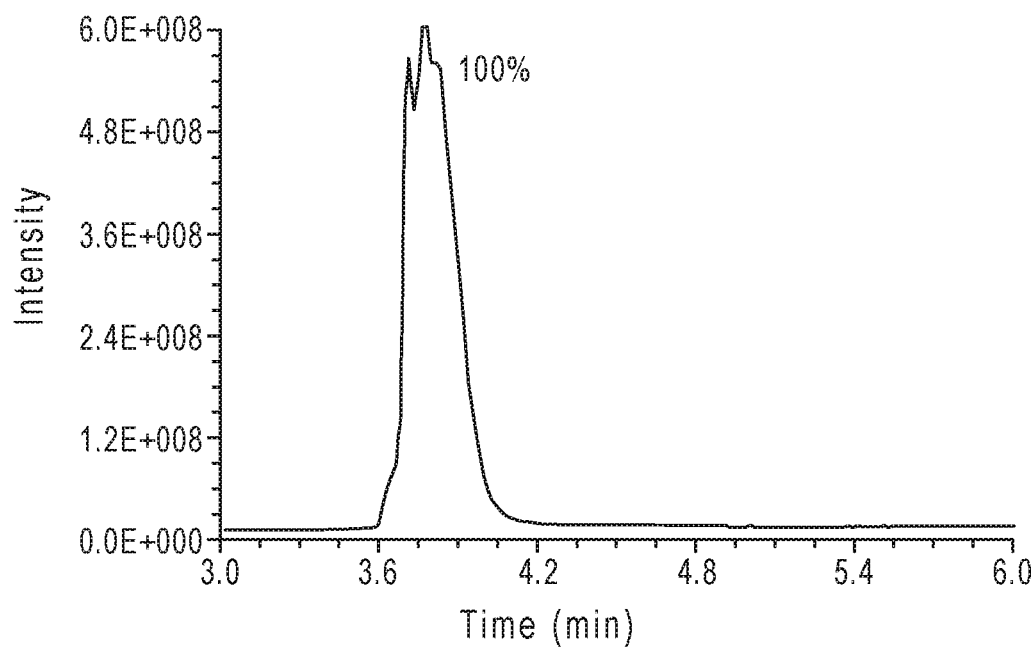
FIG. 42A shows a reversed high-pressure phase liquid chromatography (RP-HPLC) chromatogram of a dual receptor binding heterodimer Fc ligand construct as described in Example 42.

FIG. 42A shows a reversed high-pressure phase liquid chromatography (RP-HPLC) chromatogram of the heterodimeric Fc construct.

Figure 42B:
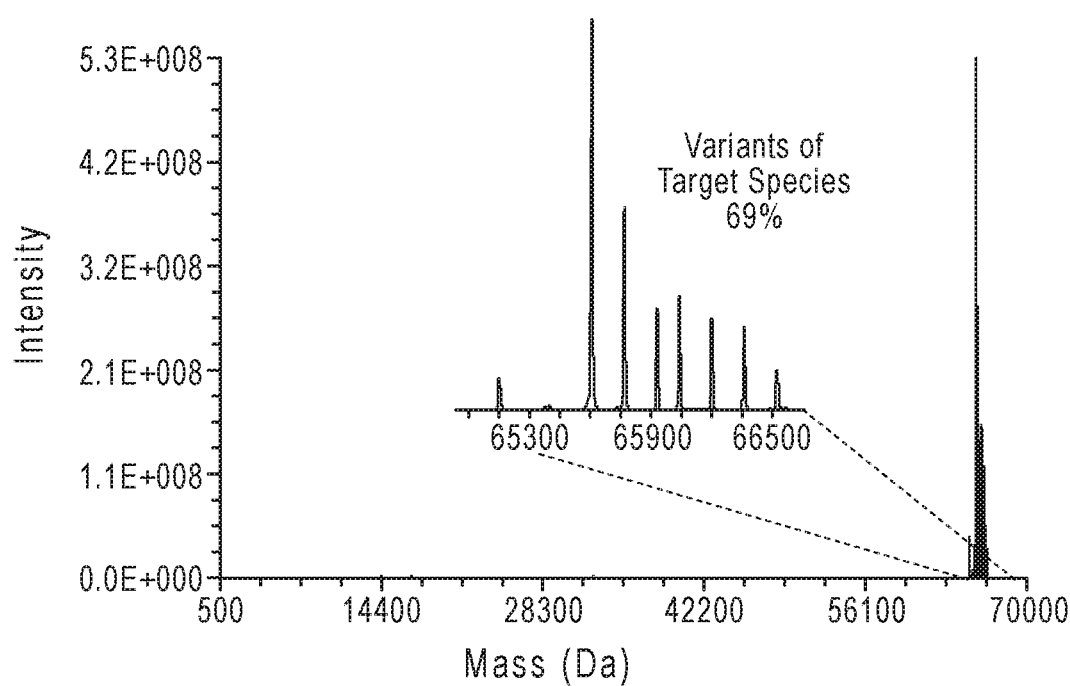
FIG. 42B shows the deconvoluted mass spectrum of the HPLC fraction eluted at 3.78 min having four (4) variants of the dual receptor binding heterodimer Fc ligand construct as described in Example 42 representing 69% of the eluted fraction.
Figure 45:
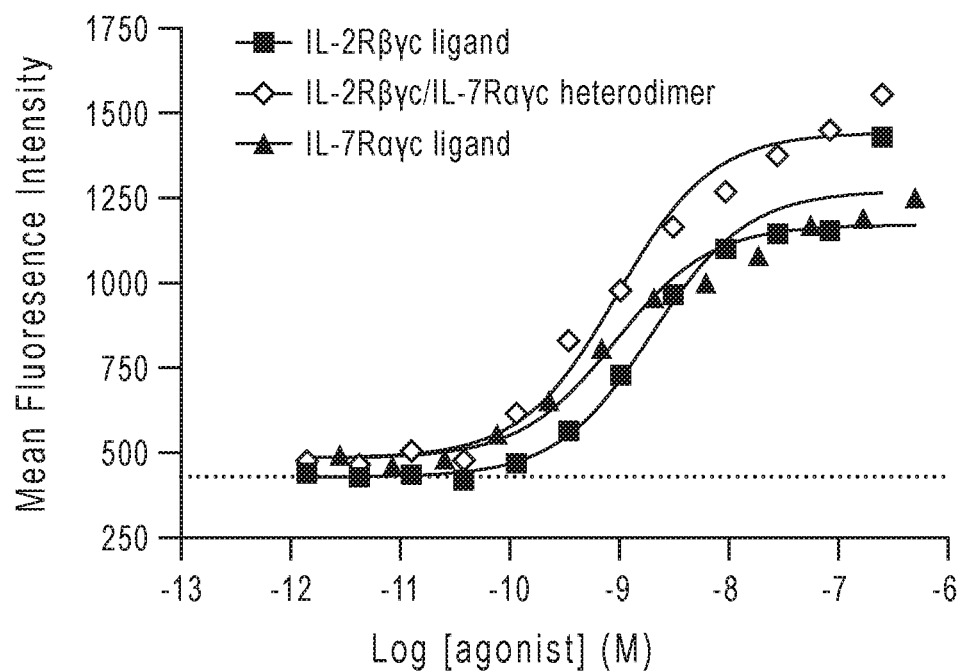
FIG. 45 shows STAT5 phosphorylation in activated CD8 T-cells exposed to an IL-2Rβγc ligand, an IL-7Rαγc ligand, or an IL-2Rβγc/IL-7Rαγc heterodimer dual binding construct.
Figure 46:
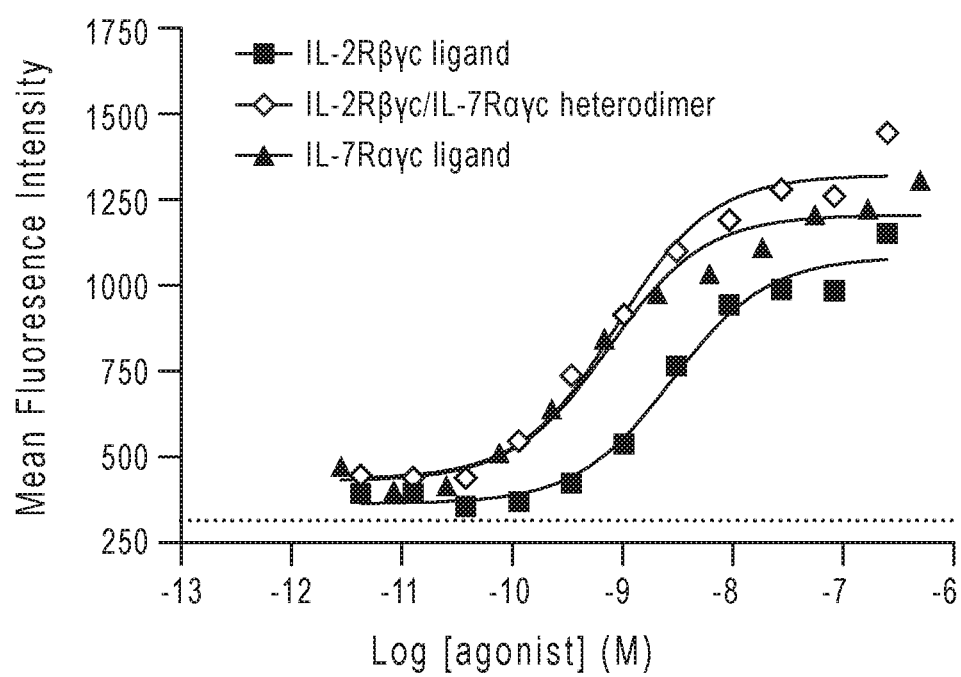
FIG. 46 shows STAT5 phosphorylation in activated CD4 Tconv-cells exposed to an IL-2Rβγc ligand, an IL-7Rαγc ligand, or an IL-2Rβγc/IL-7Rαγc heterodimer dual binding construct.
Figure 47:
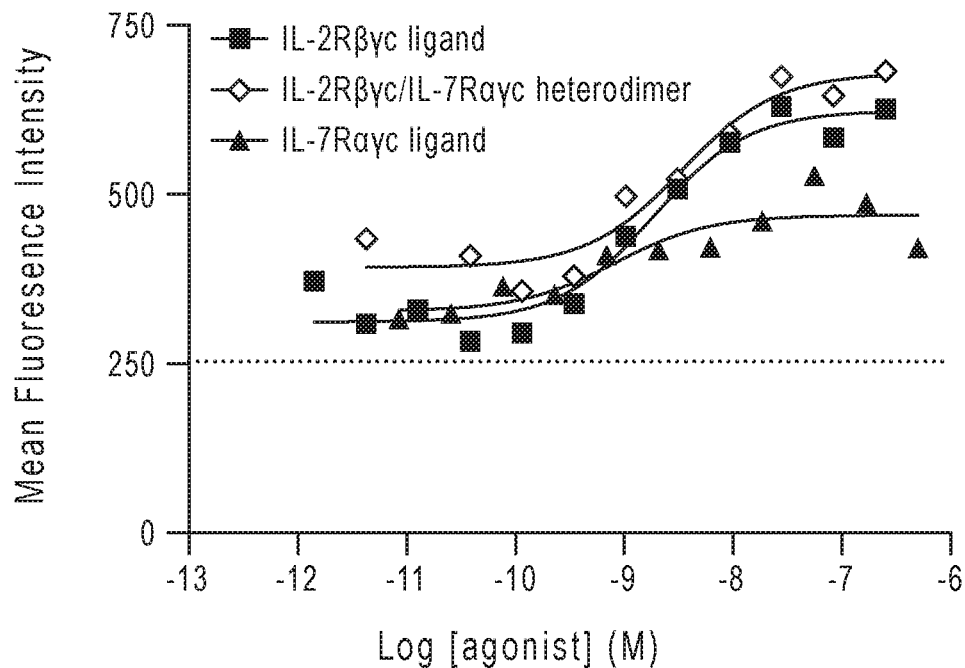
FIG. 47 shows STAT5 phosphorylation in activated NK cells exposed to an IL-2Rβγc ligand, an IL-7Rαγc ligand, or an IL-2Rβγc/IL-7Rαγc heterodimer dual binding construct.
Figure 48:
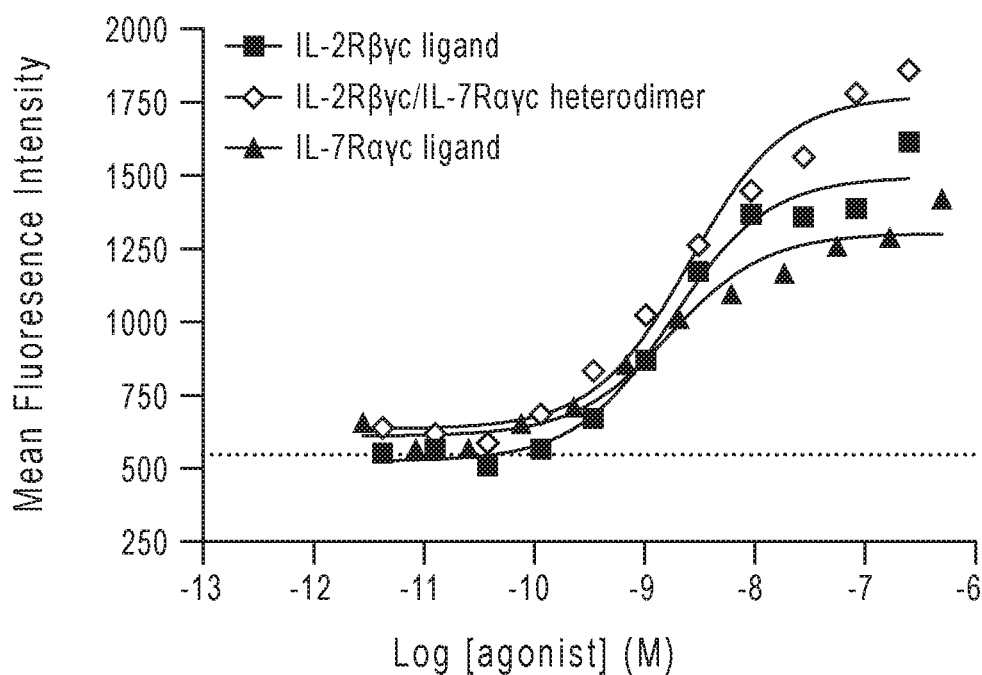
FIG. 48 shows STAT5 phosphorylation in activated CD4 Treg cells exposed to an IL-2Rβγc ligand, an IL-7Rαγc ligand, or an IL-2Rβγc/IL-7Rαγc heterodimer dual binding construct.

FIG. 42B shows the deconvoluted mass spectrum of the HPLC fraction eluted at 3.78 min having four (4) variants of the target heterodimeric Fc ligand representing 69% of the eluted fraction.

The heterodimeric Fc ligand was reduced to cleave the disulfide bonds to provide the separate knob and hole Fc constructions. The HPLC is shown in FIG. 43A and the mass spectra of the primary and secondary fractions are shown in FIG. 43B and FIG. 43C, respectively. The variants represent 98% and 94% of the target species, respectively.

The reduced heterodimeric Fc construct was deglycosylated. The RP-HPLC of the reduced and deglycosylated construct is shown in FIG. 44A. The mass spectra of the primary and secondary fractions are shown in FIG. 44B and FIG. 44C, respectively. The measured molecular weight of 31585 Da (FIG. 44B) and 31153 Da (FIG. 44C) corresponds to the theoretical molecular weight of the Fc-Knob IL-2Rβγc ligand construct and the Fc-Hole IL-7Rαγc construct, respectively.

Example 44

STAT-5 Phosphorylation in Pre-activated CD8+ T-cells, CD4+ Tconv Cells, CD4+ Treg Cells, and NK Cells The agonist activity of test compounds including an IL-2Rβγc ligand construction having SEQ ID NO: 8008, an IL-7Rαγc ligand construct having SEQ ID NO: 8009, and a dual ligand heterodimer construct comprising an IL-2Rβγc ligand construct having SEQ ID NO: 8001 and an IL-7Rαγc construct having SEQ ID NO: 8002 in pre-activated CD8+ T-cells, CD4+ Tconv cells, CD4+_Treg cells, and NK cells was evaluated using a STAT5 phosphorylation assay.

Human peripheral blood mononuclear cells (PBMC) were isolated from buffy coats using Lymphoprep® (Stemcell Technologies No. 07811) density gradient centrifugation. The recovered PBMCs were resuspended at 2×10$^6$ cells/mL in serum-free T-cell medium (CTS OpTmizer® T cell Expansion SFM, ThermoFisher Scientific No. A1048501)+2 mM L-glutamine+Pen/Strep, and stimulated with 2 µg/mL plate-immobilized anti-CD3 antibody (Purified NA/LE Mouse Anti-Human CD3, BD Biosciences #557052) and 1 µg/mL anti-CD28 antibody (Purified NA/LE Mouse Anti-Human CD28, BD Biosciences #555725) for 48 hours at 37° C. After incubation, the PBMCs were rested in fresh T-cell medium at 2×10$^6$ cells/mL with no stimulation for 72 hours. The rested PBMCs were then plated to a 96-well deep well plate at 10$^6$ cells/well. Three-fold serial dilutions of an IL-2βγc ligand (SEQ ID NO: 8008), an IL-7Rαγc ligand construct (SEQ ID NO: 8009), and a dual IL-2βγc/IL-7Rαγc heterodimer construct (SEQ ID NOS: 8001 and 8002) were added to the cells and incubated for 30 min at 37° C. The cells were then fixed in Fix/Perm® buffer (Transcription Factor Phospho Buffer Set, BD Biosciences No. 563239) for 50 min on ice, followed by permeabilization in Phosflow® Perm Buffer III (Transcription Factor Phospho Buffer Set, BD Biosciences No. 563239) for 20 minutes on ice. The cells were washed several times using Perm/Wash® buffer (Transcription Factor Phospho Buffer Set, BD Biosciences No. 563239). Antibody conjugates used for cell surface and intracellular staining are shown in Table 23.

TABLE 23

Antibody Conjugates.

| Marker | Channel | Clone | Vendor | Cat. no. |
|---|---|---|---|---|
| CD3 | AF488 | SP34 | BD[1] | 557705 |
| Foxp3 | PE | 236A/E7 | BD | 560852 |
| CD56 | PerCP-eF1710 | CMSSB | Invitrogen | 46-0567-42 |
| CD25 | AF780 | CD25-4E3 | Invitrogen | 47-0257-42 |
| pSTAT5 | BV421 | 47/STAT5 (pY694) | BD | 562984 |

TABLE 23-continued

Antibody Conjugates.

| Marker | Channel | Clone | Vendor | Cat. no. |
|---|---|---|---|---|
| CD4 | BV650 | L200 | BD | 563737 |
| CD8 | BUV737 | SK1 | BD | 612754 |
| CD16 | BUV395 | 3G8 | BD | 563785 |

[1]BD Biosciences.

Antibody mixtures were added to the cells and incubated for 30 min on ice and protected from light. Cells were washed with Perm/Wash® buffer and resuspended in PBS+ 2% FBS. Each test sample was analyzed by flow cytometry on a BD LSR Fortessa® X-20 instrument (Becton Dickinson). Data analysis was performed using FlowJo™ software. The mean fluorescence intensity (MFI) of cells in each blood cell population was plotted as a function of the concentration of the test compound.

The pSTAT5 MFI in activated CD8 T-cells, activated CD4 Tconv cells, activated NK cells, and activated CD4 Treg cells is provided in FIGS. 45-48, respectively.

Example 45

Agonist Activity of PEG-IL-2Rβγc Ligand Constructs

PEG-IL-2Rβγc ligand constructs were synthesized as described in Example 20. The structures of the PEG-IL-2Rβγc ligand constructs is shown in FIGS. 50-56. The IL-2Rβγc ligand used for each of the constructs had SEQ ID NO: 4005. The PEG constructs were incubated with NK-92 cells and STAT5 phosphorylation was measured as a function of concentration using the methods described in Examples 3 and 4, respectively.

The results are presented in Table 24.

TABLE 24

Agonist activity of PEG-IL-2Rβγc ligand constructs.

| Construct | PEG attachment terminus | PEG size | PEG/peptide linker | PEG structure | IL-2Rβ IC50 | IL-2Rγc IC50 | EC50 (STAT5, NK92) |
|---|---|---|---|---|---|---|---|
| PEG-1 | N— | 40 kD | [1]PEG10 | branched | 31 nM | 26 nM | 5.8 nM |
| PEG-2 | C— | 40 kD | [1]PEG4 | branched | 8 nM | 690 nM | 273 nM |
| PEG-3 | N— | 40 kD | (AP)6 | branched | 14 nM | 4.3 nM | 2.3 nM |
| PEG-4 | C— | 40 kD | [1]PEG10 | branched | 8.5 nM | 3.7 nM | 24 nM |
| PEG-5 | N— | 20 kD | [1]PEG20 | linear | 33 nM | 4.1 nM | 1.0 nM |
| PEG-6 | N— | 40 kD | [1]PEG20 | linear | 17 nM | 3.4 nM | 1.6 nM |
| PEG-7 | N— | 40 kD | [1]PEG20 | branched | 3.4 nM | 1.7 nM | 8.3 nM |

[1]Incorporated as Fmoc—NH-(PEG$_n$)-CH$_2$CH$_2$—COOH, where n = 4, 10, or 20.

Example 46

IL-2Rβγc PEG-Peptide Agonist PK Analysis in CD-1 Mice

A pharmacokinetic study of an IL-2Rβ γc PEG-peptide agonist was performed in CD-1 male mice. An IL-2Rβγc PEG-peptide agonist (PEG-6) was administered intravenously with a single dose of 1 mg/kg to each mouse (n=5). Blood samples were collected at 0 h (pre-dose), 1, 2, 6, 24, 48, 72 and 96 h post-dosing into serum separator vials. Samples were centrifuged at 10,000×g for 5 min at 4° C. and the serum transferred to a new tube. Samples were frozen and stored at −80° C. prior to testing.

The TF-1β STAT5 phosphorylation bioassay as described in Example 3 was used to quantify the amount of PEG-6 present in each of the serum samples. Three-fold serial dilutions of each serum sample or a compound reference standard in starvation media were added to the cells and incubated for 30 mins with the cells. Cells extracts were prepared and the quantity of phosphorylated STAT5 was determined as described in Example 3. PEG-6 concentration in each serum sample was calculated using a standard curve generated from the reference standard.

Figure 49:
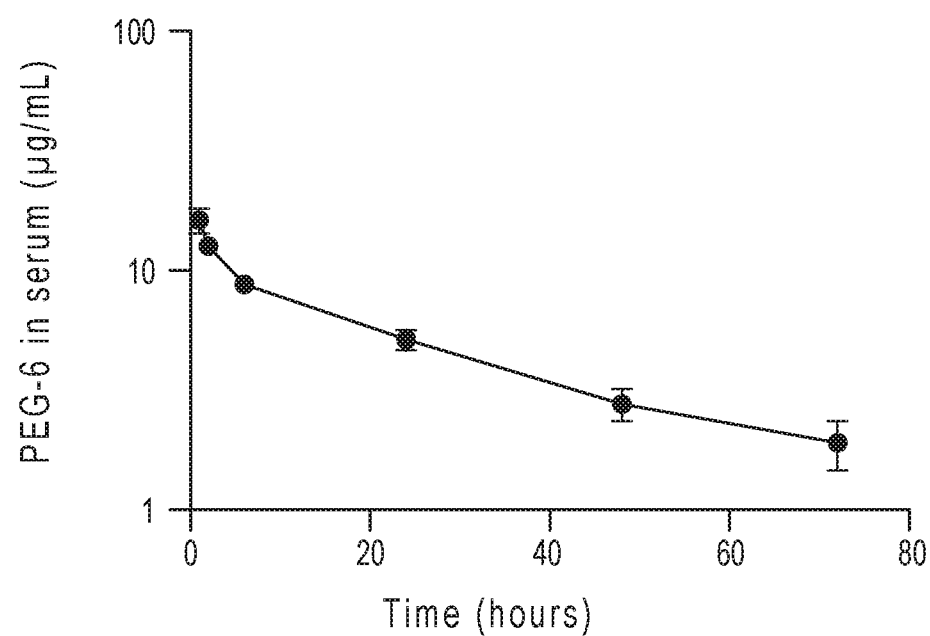
FIG. 49 shows a PK profile of a PEG-IL-2Rβγc ligand construct (PEG-1) following administration to mice.
Figure 50:
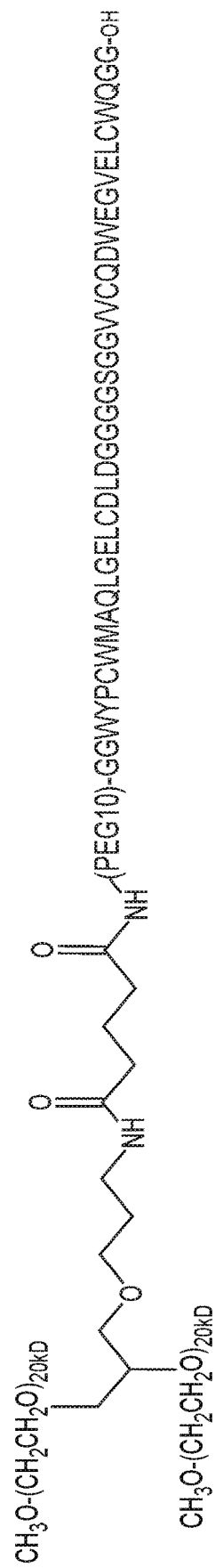
FIGS. 50-56 show examples of PEG-IL-2Rβγc ligand constructs PEG-1 to PEG-7, respectively. The IL-2Rβγc ligand has SEQ ID NO: 4005.
Figure 51:
Figure 52:
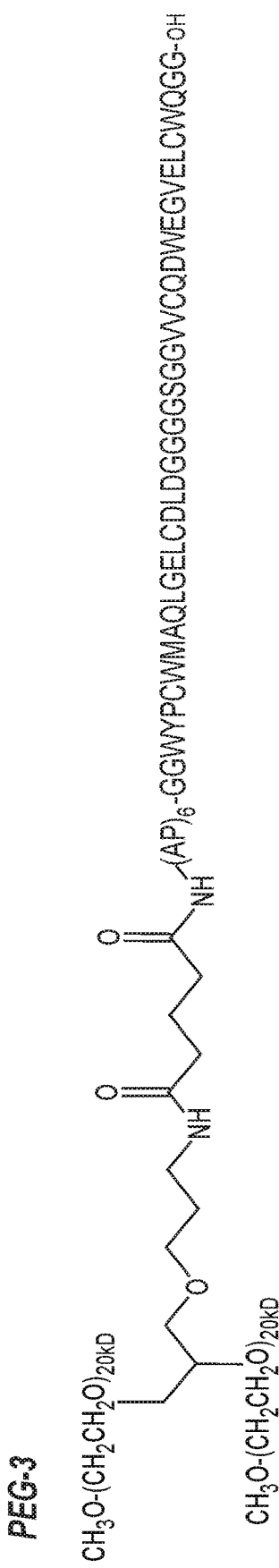
Figure 53:
Figure 54:
Figure 55:
Figure 56:

The results are presented in FIG. 49.

Example 47

Phage Display pIII Library Panning Against Fc-Receptor Fusions on Magnetic Beads (Acid Elution) Library Panning Procedure

The following protocol or similar protocol was used to screen peptides for binding to the hIL-2Rβ and the hIL-2Rγc subunits and for some peptides to the cyno-IL-2Rβ and the cyno-IL-2Rγc subunits.

Fifty (50) μL of Protein G Dynabeads® (Invitrogen) was used for each library sample. After resuspending the stock bottle, the desired volume of beads was transferred to a sterile microfuge tube and applied to the magnet.

With the beads on a magnet, the supernatant was removed, and the beads were washed with 1 mL of PT buffer (1×PBS, 0.05% Tween®20).

The supernatant was removed and 1 mL of PBS+1% BSA+0.05% Tween®20 was added and mixed at 25° C. for at least 1 hour to block the beads.

A tube was applied to the magnet and the blocking solution was removed. For each library to be tested, 5 μg of a Fc-fused receptor of interest was added to each library sample for each round to bring the total volume to at least 400 μL. The samples were mixed at 25° C. for at least 1 h. The sample was applied to the magnet and the supernatant was removed.

Two-hundred 200 μL of PT buffer was added for each 50 μL of bead. The sample was thoroughly mixed and 200 μL aliquots were transferred into tubes that were pre-labeled for each library to be screened. An additional 500 µL of PT was added to each tube, the samples mixed, and then applied to the magnet. A total of 700 µL/tube was used for the wash.

One (1) mL aliquots of the libraries removed from the −20° C. freezer. One hundred (100 µL of 10× BT buffer (5% BSA, 0.5% Tween®20 in 1×PBS) was added to each tube and vortexed. The library samples were transferred to pre-labeled tubes containing beads. The samples were then incubated at 4° C. on the rotator for at least 2 h. For the additional rounds of screening, 1 mL aliquots of the amplification from the previous round from each library was used. The beads were recovered with the magnet and the phage solution removed. The beads were washed 2× with 1 mL of PT buffer. Five hundred (500) µL of PT buffer was added and the suspension was transferred to a clean tube. The beads were recovered on the magnet and the final wash removed.

Four-hundred seventy-five (475) µL of phage elution buffer was added to each well (0.2 M glycine-HCL, pH 2.2, 1.0 mg/mL BSA). The samples were incubated at 25° C. for 10 min on the rotator. The beads were recovered on the magnet and the eluted phage transferred to a clean tube.

Twenty-five (25) µL of neutralization buffer (2 M Tris Base) was added to the 475 µL of elution. The neutralized samples were maintained at 4° C. until the TG1 cells were ready amplification. The samples were stored at −20° C. after screening. Fifty (50) µL (about 10% of the total volume) was transferred to a 1.5 mL microfuge tube and store at −20° C. for use in deep sequencing.

Example 48

TG1 Culture and Library Amplification

A fresh TG1 (or OmniMax) culture was grown for about 1 to 1.5 h after adding the libraries to the beads. 2X-YT medium (10 mL) was placed into a 50 mL Falcon® tube. Two hundred (200) µL of the TG1 overnight was added to the falcon tube. 2X-YT medium (600 µL) was placed in a cuvette for OD600 blank. The culture was grown at 250 rpm and 37° C., taking the first OD measurement after 60 min. The TG1 cells should be in log phase at the time of use with an OD600 of 0.5-0.7.

Eluted phage (400 µL to 450 µL) was added to 1.0 mL of the TG1 cells at an OD600 of 0.5-0.7 in a 50 mL Falcon® tube. The phage and TG1 cells were incubated at 37° C. for 30 min without shaking. About 50 µL to 100 µL was set aside for titering and characterization.

2YT medium (10.5 mL) was added to 12 µL of carbenicillin (carb) (100 mg/mL to make 100 µg/mL) and 24 µL of 50% glucose (to make 0.1% glucose) and the cells incubated while shaking at 37° C. at 250 rpm for 1 h.

M13K07 helper phage ($5 \times 10^{10}$ pfu, 24 µL of the stock, $2 \times 10^{12}$ pfu/mL) was then added and swirled to mix. The phage and cells were incubated at 37° C. for 30 min without shaking.

Kanamycin was diluted to 3 mg/mL and arabinose to 2.4% in 2YT medium/Carbenicillin-100/0.1% glucose and 100 µL was added to each amplification. The mixture was incubated overnight at 37° C. and 250 rpm.

The culture was transferred to a 50 mL high-speed VWR centrifuge tube and centrifuged at 8,000 g for 15 min at 4° C. in a JSP-F50C centrifuge to pellet the cells.

The supernatant was transferred to a 50 mL high-speed VWR centrifuge tube and 0.2 volumes of PEG/NaCl (multiply the volume by 0.25 mL to 3 mL PEG/NaCl for 12 mL amplification) was added, mixed, and incubated on ice for 30 minutes.

The cells were then centrifuge at 10,500 g for 15 min at 4° C. in a JSP-F50C centrifuge. The supernatant was removed, and the phage pellet was resuspended in a total of 1 mL of PBT (1×PBS, 0.05% Tween®20, 0.5% BSA) by pipetting.

The sample was transferred to an Eppendorf tube, vortexed, and centrifuged at 12,000 rpm for 30 sec. The supernatant was transferred to a clean Eppendorf tube and stored at 4° C. This amplified phage sample (250-500 µL) was used for the next round of screening.

Example 49

Preparation of Cultures from Individual Colonies

Ninety-six (96) wells of a deep well plate were filled with 1 mL of 2YT broth/Ampicillin-50/0.1% glucose. Ninety-six (96) colonies were placed into the wells using P20 tips. The tips were left in the wells to mark the position. The tips were removed using a multi-channel pipette after the entire plate was completed. The plate was covered with a breathable film.

The inoculated plate(s) were incubated in a shaker at 37° C. until the cultures became turbid, typically within 4 h at 250 rpm.

The plate(s) was removed from the incubator and 50 µL of the culture from each well was removed to another deep well block designated as the "Archive Block" containing 1 mL of 2YT broth/Ampicillin-50/0.1% glucose. The plate(s) were covered with a breathable film and incubated overnight at 37° C. and 250 rpm.

After incubating overnight, M13K07 helper phage was added to $2 \times 10^{10}$ pfu/mL in 2YT broth/Ampicillin-50/0.1% glucose (make 6.0 mL per block). Fifty (50) µL of the diluted M13K07 was added to each culture well in the deep well block. The deep well block was covered with breathable film and incubated for 30 min at 37° C. and 250 rpm.

Kanamycin was diluted to 0.5 mg/mL and arabinose to 0.4% in 2YT broth/Ampicillin-50/0.1% glucose (make 6.0 mL per block) and 50 µL was added to each well. The plate was covered with a breathable film and incubated overnight at 37° C. and 250 rpm.

The "Archive Block" culture was removed from the incubator and 50 µL was transferred to a 96-well plate containing 50 µL of 50% glycerol. The plate was sealed with foil and stored at −80° C. The remaining culture in the block was covered with a foil seal and stored at 4° C.

The block was centrifuged and inoculated with M13K07 at 4000 rpm for 15 min. While avoiding the bacterial pellet, 850 µL of the phage supernatant was transferred to a fresh deep well plate, covered with a foil seal, and stored at 4° C.

Example 50

ELISA Protocol for Fc-Fusions

For each block to be assayed, a 1×96 well ELISA plate was coated with Fc-fusion (1 µg/mL in PBS) at 50 µL/well. The wells were incubated at 25° C. for at least 1 h.

The Fc-fusion was removed from each well. Three hundred (300) µL of blocking buffer (1×PBS, 1% BSA) was added to each well of a receptor-coated plate. Also, 300 µL of the blocking buffer was added to a separate uncoated 96-well ELISA plate to be used as the negative control. Both plates were covered with film and left at 37° C. for 1 h or overnight at 4° C.

The plate was washed 4 times with PT (1×PBS, 0.05% Tween® 20) buffer.

Fifty (50) µL of PBT was added to each well. Fifty (50) µL of the phage supernatant from the block was added to each well and incubated at 4° C. for 1 h.

The plates were washed 4 times with cold PT.

To each well 100 µL of anti-M13-HRP antibody diluted 1:5000 in cold PBT was added. The wells were incubated for 1 h at 4° C.

The plates were then washed 4 times with cold PT.

Fifty (50) µL of TMB was then added to each well, and the wells were incubated for 1-10 min at 25° C. Fifty (50) µL of a "stop" solution was added and the plate read at 450 nm.

Example 51

Evaluation of Peptide Heterodimer Ability to Dimerize IL-2Rβγc and to Activate IL-2 Responsive Cells Following the identification of peptidyl ligands that exhibit IL-2Rβ and IL-2Rγc binding activity, compounds will be identified that exhibit IL-2R agonist activity. This will involve assessing the ability of the peptide to dimerize the IL-2Rβγc subunits and to signal in cell-based assays. Dimerization is a necessary, but not sufficient, step in the activation of receptor signaling. To assess agonist activity in cell-based assays, IL-2 responsive cell lines will be tested for an indicator of IL-2 signaling, phosphorylation of STAT5. Compounds that exhibit IL-2Rβγc agonist activity in these cell lines will then be tested in primary human peripheral blood mononuclear cells (PBMC) for IL-2R agonism, and for the desired selectivity favoring activation of cell types expressing IL-2Rβγc subunits, but with low or no IL-2Rα (CD25) subunit expression.

Dimerization potential will be assessed using a β-Gal complementation system in which a portion of the intracellular domains of each respective IL-2 receptor subunit is replaced with functionally complementary fragments of β-Gal, which regain catalytic activity when brought into sufficiently proximity. Cells expressing these constructs generate β-Gal activity, with an ED50 of about 26 nM, when treated with IL-2 (see DiscoverX product specifications). All synthetic, potentially agonist, peptides will be tested using this assay.

Candidate compounds will be scored for induction of STAT5 phosphorylation in two cell lines: (1) CTLL-2 cells, a mouse cytotoxic T-lymphocyte line that expresses all three IL-2 receptor subunits, and which are responsive to IL-2Rβγc-biased variants as well as wild type IL-2; and (2) TF-1β cells which are derived from the human erythroleukemia line TF-1, and naturally express only IL-2Rγc, and are engineered to be IL-2 responsive by transfection of IL-2Rβ. TF-1β will be constructed and IL-2R subunit expression levels in both cell lines will be verified by QPCR and FACS analysis.

Compounds will be tested in both cell lines. Dose response assays will be conducted to determine EC50 of the test compounds and to compare the test compounds with IL-2 as an indicator of IL-2Rβγc receptor bias. To further characterize subunit bias, a parallel assay will be run in the presence of a neutralizing antibody to the human IL-2Rβ subunit.

As a control to confirm that positive compounds are acting through stimulation of the IL-2 receptor, the assay will also be done with cells treated with neutralizing anti-huIL-2Rβ antibody. To determine that compound activity is not due to contamination with cytokines, test compounds will be treated with neutralizing antibodies (R&D Systems) against the natural IL-2Rβγc agonists, IL-2 and IL-15.

Compounds exhibiting IL-2R agonist activity in the cell lines will be tested on human primary immune cells, PBMCs, collected from individual donors (commercially available from Lonza), and in some cases on purified CD4+ cells (Lonza). A substantial fraction of PBMCs from normal donors are responsive to IL-2. To assess IL-2 agonist activity of the test compounds, cells will be exposed to the compounds or IL-2 and scored for STAT5 phosphorylation by western blot analysis. As a control to confirm that positive compounds are acting through stimulation of the IL-2 receptor, the assay will also be done with cells treated with neutralizing anti-huRβ antibody.

Those compounds exhibiting STAT5 activation of PBMCs will be subjected to a follow-on assay designed to assess subunit bias of the compounds compared to IL-2. This assay will involve determining a dose response of the test compounds and IL-2 (1 to 1000 IU) over 30 min, scored by a FACS-based protocol allowing detection of both intracellular pSTAT5 as an indicator of IL-2R activation, and cell surface CD25, the IL-2Rβ subunit. Cells expressing the three IL-2R subunits, IL-2Rβγc, bind IL-2 with very high affinity (about 10 µM) and are therefore sensitive to low concentrations of IL-2; whereas cells expressing only IL-2Rβγc (about 1 nM affinity) require exposure to substantially higher IL-2 levels for activation. Because compounds provided by the present disclosure are selected for binding to the IL-2Rβ and IL-2Rγc subunits, but not to IL-2Rα, the potency of the compounds is expected to be uncorrelated with the level of expression of IL-2Rα on cells; and comparison of response profiles of cells treated with compounds provided by the present disclosure or treated with IL-2 should reveal any bias.

Example 52

Identified Peptides

Stochastic libraries with each library containing approximately $10^{10}$ independent recombinants, with each clone potentially displaying a unique peptide sequence have been screened for binding to human IL-2Rβ or human Il-2Rγc subunits.

Example 53

Preparation of NK-92 Cells for Testing STAT5 Activation of hIL-2R

NK-92 cells were seeded in a 24-well plate at $4\times10^5$ cells, in 1 mL starvation medium (SM), and incubated overnight at 37° C., 5% $CO_2$. The starvation medium contained RPMI 1640+20% FBS+2 mM L-glutamine+1 mM NaPyr+10 mM HEPES+0.1 mM BME (no rhIL-2 supplement).

Treatment mixtures were of 1 μg/mL Anti-hIL-2 neutralizing antibody (0.2 mg/mL stock) or goat IgG control (1 mg/mL stock) were prepared.

The treatment mixtures and the antibody mix were added to the cells for 30 min at 37° C., 5% $CO_2$. Each sample was then transferred to a 1.5 mL microfuge tube and spun down at 1,500 RPM for 5 minutes. The cells were washed in 1 mL PBS and centrifuged again.

A phosphatase and protease inhibitor cocktail (Thermo #78442) were added to mPER buffer at a 1:100 dilution. After the cells were pelleted, 50 μL of mPER buffer was added to each sample and pipetted repeatedly to homogenize.

The lysates were centrifuged at 14,000 RPM for 5 min at RT. The supernatants were transferred to clean tubes and stored frozen at −80° C.

The human IL-2 Antibody (goat IgG) was obtained from R&D Systems No. AF-202-NA; the normal goat IgG Control was obtained from R&D Systems No. AB-108-C; the Anti-STAT5 Antibody (rabbit), the Cell Signaling No. 94205S, the Anti-pSTAT5 Antibody (rabbit), the Cell Signaling No. 4322S, and the Goat anti-rabbit IgG-HRP was obtained from Jackson Immunoresearch No. 111-035-144.

The antibodies, treatment and working stock prep for each of the samples is provided in Table 25. Compounds A and B are IL-2Rβγc agonists provided by the present disclosure.

TABLE 25

| | | | | | |
|---|---|---|---|---|---|
| STAT5 activation samples in NK-92 cells. | | | | | |
| No. | Antibody | Vol (μL) | Treatment | Vol (μL) | Working stock prep |
| 1 | Anti-hIL-2 IgG | 5 | A 10 μM | 100 | 100 μM (1:100 of 10 mM stock in SM) |
| 2 | Anti-hIL-2 IgG | 5 | A 1 μM | 10 | 100 μM (1:100 of 10 mM stock in SM) |
| 3 | Anti-hIL-2 IgG | 5 | A 0.1 μM | 1 | 100 μM (1:100 of 10 mM stock in SM) |
| 4 | Anti-hIL-2 IgG | 5 | B 10 μM | 100 | 100 μM (1:100 of 10 mM stock in SM) |
| 5 | Anti-hIL-2 IgG | 5 | B 1 μM | 10 | 100 μM (1:100 of 10 mM stock in SM) |
| 6 | Anti-hIL-2 IgG | 5 | B 0.1 μM | 1 | 100 μM (1:100 of 10 mM stock in SM) |
| 7 | Anti-hIL-2 IgG | 5 | rh-IL2 1 ng/mL | 10 | 100 ng/mL (1:1000 of 100 μg/mL stock in SM) |
| 8 | Anti-hIL-2 IgG | 5 | rhIL-2 0.1 ng/mL | 1 | 100 ng/mL (1:1000 of 100 μg/mL stock in SM) |
| 9 | Anti-hIL-2 IgG | 5 | rhIL-2 0.1 ng/mL + 1% DMSO | 1 | 100 ng/mL (1:1000 of 100 μg/mL stock in SM) + 10 μL DMSO |
| 10 | Anti-hIL-2 IgG | 5 | Starvation Medium (SM) | N/A | N/A |
| 11 | Goat IgG control | 1 | A 10 μM | 100 | 100 μM (1:100 of 10 mM stock in SM) |
| 12 | Goat IgG control | 1 | A 1 μM | 10 | 100 μM (1:100 of 10 mM stock in SM) |
| 13 | Goat IgG control | 1 | A 0.1 μM | 1 | 100 μM (1:100 of 10 mM stock in SM) |
| 14 | Goat IgG control | 1 | B 10 μM | 100 | 100 μM (1:100 of 10 mM stock in SM) |
| 15 | Goat IgG control | 1 | B 1 μM | 10 | 100 μM (1:100 of 10 mM stock in SM) |
| 16 | Goat IgG control | 1 | B 0.1 μM | 1 | 100 μM (1:100 of 10 mM stock in SM) |
| 17 | Goat IgG control | 1 | rh-IL2 1 ng/mL | 10 | 100 ng/mL (1:1000 of 100 μg/mL stock in SM) |
| 18 | Goat IgG control | 1 | rhIL-2 0.1 ng/mL | 1 | 100 ng/mL (1:1000 of 100 μg/mL stock in SM) |

TABLE 25-continued

STAT5 activation samples in NK-92 cells.

| No. | Antibody | Vol (μL) | Treatment | Vol (μL) | Working stock prep |
|---|---|---|---|---|---|
| 19 | Goat IgG control | 1 | rhIL-2 0.1 ng/mL + 1% DMSO | 1 | 100 ng/mL (1:1000 of 100 μg/mL stock in SM) + 10 μL DMSO |
| 20 | Goat IgG control | 1 | Starvation Medium (SM) | N/A | N/A |

The samples were applied to a Western Blot. The treatment reagents included Anti-STAT5 Antibody (rabbit), Cell Signaling No. 94205S; Anti-pSTAT5 Antibody (rabbit), Cell Signaling No. 4322S; and Goat anti-rabbit IgG-HRP, Jackson Immunoresearch No. 111-035-144.

To perform the assay, NK-92 cells were plated in starvation medium at 20,000 cells/well in α96-well plate. Treatment was added to each well in 3-fold serial dilutions with the peptides having maximum concentration of 10 μM and rhL-2 having a maximum concentration of 6.67 nM. The cells were then incubated at 37° C. for 48 h. CellTiter-Glo® reagent was added and the cells incubated for 10 min at 25° C. before luminescence reading.

Example 54

Preparation of TF-1β3 and TF-1 Cells for Testing STAT5 Activation of hIL-2R

TF-1β and TF-1 parental cells were counted. The cells were collected and $2.5 \times 10^6$ cells pelleted at 200×g for 5 minutes. The pelleted cells were washed with 25 mL RPMI with no additives.

The TF-1β and TF-1 parental cells were seeded at $5 \times 10^5$ cells in a T25 flask, in 5 mL starvation medium (SM), and incubated overnight with the flask upright at 37° C. under 5% $CO_2$.

The TF-1β and TF-1 parental cells were counted, and the viability was determined. If necessary, the cells were diluted to $5 \times 10^5$ cells/mL in SM and then 1 mL of the suspension was added to 6 wells/cell line of a 24-well dish and incubate at 37° C. under 5% $CO_2$.

The treatments (see Example 7) were added to the cells for 30 min at 37° C. under 5% $CO_2$. The treated cells were transferred to a 1.5 mL microfuge tube and spun down at 1,500 RPM for 5 min. The cells were washed in 1 mL PBS, centrifuged again, and the supernatant aspirated. The treatment reagents included Anti-STAT5 Antibody (rabbit), Cell Signaling No. 94205S; Anti-pSTAT5 Antibody (rabbit), Cell Signaling No. 4322S; and Goat anti-rabbit IgG-HRP, Jackson Immunoresearch No. 111-035-144.

A phosphatase and protease inhibitor cocktail (Thermo No. 78442) were added to mPER buffer at 1:100 dilution. After the cells were pelleted, add 50 μL of mPER buffer was added to each sample and the mixture repeatedly pipetted to homogenize.

The lysates were centrifuged at 14,000 RPM for 5 min at 25° C. The supernatants were transferred to clean tubes and stored frozen at −80° C.

The antibodies, treatment and working stock prep for each of the samples is provided in Table 26. Compounds A and B are IL-2Rβγc agonists provided by the present disclosure.

TABLE 26

STAT5 activation samples in TF-1β and TF-1 cells.

| # | Cell line | Treatment | Vol (μL) | Working stock prep |
|---|---|---|---|---|
| 1 | TF-1β | A 10 μM | 100 | 100 μM (1:100 of 10 mM stock in SM) |
| 2 | TF-1β | B 10 μM | 100 | 100 μM (1:100 of 10 mM stock in SM) |
| 3 | TF-1β | C 10 μM | 100 | 100 μM (1:100 of 10 mM stock in SM) |
| 4 | TF-1β | rhIL-2 1 ng/mL | 10 | 100 ng/mL (1:1000 of 100 μg/mL stock in SM) |
| 5 | TF-1β | Starvation Medium[1] (SM) | 100 | N/A |
| 6 | TF-1 | A 10 μM | 100 | 100 μM (1:100 of 10 mM stock in SM) |
| 7 | TF-1 | B 10 μM | 100 | 100 μM (1:100 of 10 mM stock in SM) |
| 8 | TF-1 | C 10 μM | 100 | 100 μM (1:100 of 10 mM stock in SM) |
| 9 | TF-1 | rhIL-2 1 ng/mL | 10 | 100 ng/mL (1:1000 of 100 μg/mL stock in SM) |
| 10 | TF-1 | Starvation Medium[1] (SM) | 100 | N/A |

[1]Starvation medium: RPMI 1640, 2.5 g/L glucose (4.5 g/L total), 5% FBS, 2 mM L-glutamine, 1 mM NaPyr, and 10 mM HEPES (no GM-CSF supplement).

Finally, it should be noted that there are alternative ways of implementing the embodiments disclosed herein. Accordingly, the present embodiments are to be considered as illustrative and not restrictive, and the claims are not to be limited to the details given herein but may be modified within the scope and equivalents thereof.

SEQUENCE LISTING (9624 sequences)

SEQ ID NO: 1 - protein, 8 aa, Artificial Sequence
  Description of Artificial Sequence: Synthetic peptide
  MOD_RES (1)..(1): Any amino acid
  MOD_RES (2)..(2): Any amino acid
  MOD_RES (3)..(3): Any amino acid comprising a small hydrophobic side chain
  MOD_RES (4)..(4): Any amino acid
  MOD_RES (5)..(5): Any amino acid comprising a large hydrophobic side chain
  MOD_RES (6)..(6): Any amino acid comprising a small hydrophobic side chain
  MOD_RES (7)..(7): Any amino acid comprising a polar-neutral or an acidic side chain
  MOD_RES (8)..(8): Any amino acid comprising a large hydrophobic side chain
XXXXXXXX

SEQ ID NO: 2 - protein, 10 aa, Artificial Sequence
  Description of Artificial Sequence: Synthetic peptide
  MOD_RES (2)..(2): Any amino acid
  MOD_RES (3)..(3): Any amino acid
  MOD_RES (4)..(4): Any amino acid comprising a small hydrophobic side chain
  MOD_RES (5)..(5): Any amino acid
  MOD_RES (6)..(6): Any amino acid comprising a large hydrophobic side chain
  MOD_RES (7)..(7): Any amino acid comprising a small hydrophobic side chain
  MOD_RES (8)..(8): Any amino acid comprising a polar-neutral or an acidic side chain
  MOD_RES (9)..(9): Any amino acid comprising a large hydrophobic side chain
CXXXXXXXXC

SEQ ID NO: 3 - protein, 12 aa, Artificial Sequence
  Description of Artificial Sequence: Synthetic peptide
  MOD_RES (1)..(1): Any amino acid
  MOD_RES (3)..(3): Any amino acid
  MOD_RES (4)..(4): Any amino acid
  MOD_RES (5)..(5): Any amino acid comprising a small hydrophobic side chain
  MOD_RES (6)..(6): Any amino acid
  MOD_RES (7)..(7): Any amino acid comprising a large hydrophobic side chain
  MOD_RES (8)..(8): Any amino acid comprising a small hydrophobic side chain
  MOD_RES (9)..(9): Any amino acid comprising a polar-neutral or an acidic side chain
  MOD_RES (10)..(10): Any amino acid comprising a large hydrophobic side chain
  MOD_RES (12)..(12): Any amino acid
XCXXXXXXXXCX

SEQ ID NO: 4 - protein, 14 aa, Artificial Sequence
  Description of Artificial Sequence: Synthetic peptide
  MOD_RES (1)..(1): Any amino acid
  MOD_RES (2)..(2): Any amino acid
  MOD_RES (4)..(4): Any amino acid
  MOD_RES (5)..(5): Any amino acid
  MOD_RES (6)..(6): Any amino acid comprising a small hydrophobic side chain
  MOD_RES (7)..(7): Any amino acid
  MOD_RES (8)..(8): Any amino acid comprising a large hydrophobic side chain
  MOD_RES (9)..(9): Any amino acid comprising a small hydrophobic side chain
  MOD_RES (10)..(10): Any amino acid comprising a polar-neutral or an acidic side chain
  MOD_RES (11)..(11): Any amino acid comprising a large hydrophobic side chain
  MOD_RES (13)..(13): Any amino acid
  MOD_RES (14)..(14): Any amino acid comprising a large hydrophobic side chain
XXCXXXXXXXXCXX

SEQ ID NO: 5 - protein, 14 aa, Artificial Sequence
  Description of Artificial Sequence: Synthetic peptide
AFCDEARVGELCVM

SEQ ID NO: 6 - protein, 14 aa, Artificial Sequence
  Description of Artificial Sequence: Synthetic peptide
ALCQAAQVGQLCDL

SEQ ID NO: 7 - protein, 8 aa, Artificial Sequence
  Description of Artificial Sequence: Synthetic peptide
AIAQLYDL

SEQ ID NO: 8 - protein, 8 aa, Artificial Sequence
  Description of Artificial Sequence: Synthetic peptide
AQATVGQY

SEQ ID NO: 9 - protein, 14 aa, Artificial Sequence
  Description of Artificial Sequence: Synthetic peptide
CCYQAMVGDLCDFC

SEQ ID NO: 10 - protein, 14 aa, Artificial Sequence
  Description of Artificial Sequence: Synthetic peptide
DDCSTAQVGELCVM

SEQ ID NO: 11 - protein, 14 aa, Artificial Sequence
  Description of Artificial Sequence: Synthetic peptide
DTCAIAQLYDLCDL

SEQ ID NO: 12 - protein, 14 aa, Artificial Sequence
  Description of Artificial Sequence: Synthetic peptide
DYCRNSNVGDVCYL

SEQ ID NO: 13 - protein, 14 aa, Artificial Sequence
  Description of Artificial Sequence: Synthetic peptide
DHCSEAQIGQLDHL

SEQ ID NO: 14 - protein, 14 aa, Artificial Sequence
  Description of Artificial Sequence: Synthetic peptide
DPCYAAVLNSLCDI

SEQ ID NO: 15 - protein, 14 aa, Artificial Sequence
  Description of Artificial Sequence: Synthetic peptide
DSCQNAPLGSYCVL

SEQ ID NO: 16 - protein, 8 aa, Artificial Sequence
  Description of Artificial Sequence: Synthetic peptide
DEARVGEL

SEQ ID NO: 17 - protein, 8 aa, Artificial Sequence
  Description of Artificial Sequence: Synthetic peptide
DQATLGQI

SEQ ID NO: 18 - protein, 8 aa, Artificial Sequence
  Description of Artificial Sequence: Synthetic peptide
DMADLFTL

SEQ ID NO: 19 - protein, 8 aa, Artificial Sequence
  Description of Artificial Sequence: Synthetic peptide
DTAAVGDL

SEQ ID NO: 20 - protein, 8 aa, Artificial Sequence
  Description of Artificial Sequence: Synthetic peptide
DKATVGQM

SEQ ID NO: 21 - protein, 8 aa, Artificial Sequence
  Description of Artificial Sequence: Synthetic peptide
DVASVGSY

SEQ ID NO: 22 - protein, 14 aa, Artificial Sequence
  Description of Artificial Sequence: Synthetic peptide
EDCRYAEVGVLCQM

SEQ ID NO: 23 - protein, 8 aa, Artificial Sequence
  Description of Artificial Sequence: Synthetic peptide
ERAQIGEV

SEQ ID NO: 24 - protein, 8 aa, Artificial Sequence
  Description of Artificial Sequence: Synthetic peptide
EVARLGDY

SEQ ID NO: 25 - protein, 8 aa, Artificial Sequence
  Description of Artificial Sequence: Synthetic peptide
EYSKVGEV

SEQ ID NO: 26 - protein, 8 aa, Artificial Sequence
  Description of Artificial Sequence: Synthetic peptide
EVAKVGEL

SEQ ID NO: 27 - protein, 8 aa, Artificial Sequence
  Description of Artificial Sequence: Synthetic peptide
EDALLGDF

SEQ ID NO: 28 - protein, 8 aa, Artificial Sequence
  Description of Artificial Sequence: Synthetic peptide
EYATLGSL

SEQ ID NO: 29 - protein, 14 aa, Artificial Sequence
  Description of Artificial Sequence: Synthetic peptide
FDCQTAELGDLCIV

SEQ ID NO: 30 - protein, 14 aa, Artificial Sequence
  Description of Artificial Sequence: Synthetic peptide
FFCYLIGQDEFCEF

SEQ ID NO: 31 - protein, 14 aa, Artificial Sequence
  Description of Artificial Sequence: Synthetic peptide
FPCQIAMIGEYCDW

SEQ ID NO: 32 - protein, 14 aa, Artificial Sequence
  Description of Artificial Sequence: Synthetic peptide
FRCWEAPVGEICEL

SEQ ID NO: 33 - protein, 14 aa, Artificial Sequence
  Description of Artificial Sequence: Synthetic peptide
FSCDQATLGQICVI

SEQ ID NO: 34 - protein, 8 aa, Artificial Sequence
  Description of Artificial Sequence: Synthetic peptide
FEAQIGMI

SEQ ID NO: 35 - protein, 8 aa, Artificial Sequence
  Description of Artificial Sequence: Synthetic peptide
FLAAVGQI

SEQ ID NO: 36 - protein, 8 aa, Artificial Sequence
  Description of Artificial Sequence: Synthetic peptide
FQAPIGSL

SEQ ID NO: 37 - protein, 8 aa, Artificial Sequence
  Description of Artificial Sequence: Synthetic peptide
FQAQVGQL

SEQ ID NO: 38 - protein, 8 aa, Artificial Sequence
  Description of Artificial Sequence: Synthetic peptide
FYATLGQV

SEQ ID NO: 39 - protein, 14 aa, Artificial Sequence
  Description of Artificial Sequence: Synthetic peptide
GDCYFSQIGELCML

SEQ ID NO: 40 - protein, 14 aa, Artificial Sequence
  Description of Artificial Sequence: Synthetic peptide
GPCQQAKLGELCDL

SEQ ID NO: 41 - protein, 8 aa, Artificial Sequence
  Description of Artificial Sequence: Synthetic peptide
GVWDLWPD

SEQ ID NO: 42 - protein, 8 aa, Artificial Sequence
  Description of Artificial Sequence: Synthetic peptide
GDAQLGEV

SEQ ID NO: 43 - protein, 8 aa, Artificial Sequence
  Description of Artificial Sequence: Synthetic peptide
GIALQGQL

SEQ ID NO: 44 - protein, 8 aa, Artificial Sequence
  Description of Artificial Sequence: Synthetic peptide
GIAQIGQV

SEQ ID NO: 45 - protein, 8 aa, Artificial Sequence
  Description of Artificial Sequence: Synthetic peptide
GDASLGQL

SEQ ID NO: 46 - protein, 8 aa, Artificial Sequence
  Description of Artificial Sequence: Synthetic peptide
HLAQVGEF

SEQ ID NO: 47 - protein, 8 aa, Artificial Sequence
  Description of Artificial Sequence: Synthetic peptide
HQAQIGEL

SEQ ID NO: 48 - protein, 14 aa, Artificial Sequence
  Description of Artificial Sequence: Synthetic peptide
IDCAQATVGQYCTL

SEQ ID NO: 49 - protein, 14 aa, Artificial Sequence
  Description of Artificial Sequence: Synthetic peptide
IDCSDAAVGALCTQ

SEQ ID NO: 50 - protein, 14 aa, Artificial Sequence
  Description of Artificial Sequence: Synthetic peptide
IDCTRASLGDICVW

SEQ ID NO: 51 - protein, 14 aa, Artificial Sequence
  Description of Artificial Sequence: Synthetic peptide
IECERAQIGEVCQI

SEQ ID NO: 52 - protein, 14 aa, Artificial Sequence
  Description of Artificial Sequence: Synthetic peptide
IFCGDAQLGEVCSL

SEQ ID NO: 53 - protein, 14 aa, Artificial Sequence
  Description of Artificial Sequence: Synthetic peptide
IFCQFARLGQTCQL

SEQ ID NO: 54 - protein, 14 aa, Artificial Sequence
  Description of Artificial Sequence: Synthetic peptide
IPCSIAQLFSLCDV

SEQ ID NO: 55 - protein, 14 aa, Artificial Sequence
  Description of Artificial Sequence: Synthetic peptide
IPCYLAELGQVCSL

SEQ ID NO: 56 - protein, 14 aa, Artificial Sequence
  Description of Artificial Sequence: Synthetic peptide
IRCEDALLGDFCIF

SEQ ID NO: 57 - protein, 14 aa, Artificial Sequence
  Description of Artificial Sequence: Synthetic peptide
IGCSLARLGEYCVI

SEQ ID NO: 58 - protein, 14 aa, Artificial Sequence
  Description of Artificial Sequence: Synthetic peptide
IPCSVARVGWLCDL

SEQ ID NO: 59 - protein, 14 aa, Artificial Sequence
  Description of Artificial Sequence: Synthetic peptide
KNCEVARLGDYCEI

SEQ ID NO: 60 - protein, 14 aa, Artificial Sequence
  Description of Artificial Sequence: Synthetic peptide
LACSQAPLGTLCEI

SEQ ID NO: 61 - protein, 14 aa, Artificial Sequence
  Description of Artificial Sequence: Synthetic peptide
LDCGIALQGQLCDY

SEQ ID NO: 62 - protein, 14 aa, Artificial Sequence
  Description of Artificial Sequence: Synthetic peptide
LDCSLSSLGDYCYM

SEQ ID NO: 63 - protein, 14 aa, Artificial Sequence
  Description of Artificial Sequence: Synthetic peptide
LGCFEAQIGMICDL

SEQ ID NO: 64 - protein, 14 aa, Artificial Sequence
  Description of Artificial Sequence: Synthetic peptide
LHCYLAVLGQLCDV

SEQ ID NO: 65 - protein, 14 aa, Artificial Sequence
  Description of Artificial Sequence: Synthetic peptide
LLCQVASLGDYCTI

SEQ ID NO: 66 - protein, 14 aa, Artificial Sequence
  Description of Artificial Sequence: Synthetic peptide
LPCDMADLFTLCDY

SEQ ID NO: 67 - protein, 14 aa, Artificial Sequence
  Description of Artificial Sequence: Synthetic peptide
LSCGIAQIGQVCDM

SEQ ID NO: 68 - protein, 14 aa, Artificial Sequence
  Description of Artificial Sequence: Synthetic peptide
LWCQDAQIGDVCWL

SEQ ID NO: 69 - protein, 14 aa, Artificial Sequence
  Description of Artificial Sequence: Synthetic peptide
LFCHQAQIGELCSV

SEQ ID NO: 70 - protein, 14 aa, Artificial Sequence
  Description of Artificial Sequence: Synthetic peptide
LECWQAQKGDLCDL

SEQ ID NO: 71 - protein, 14 aa, Artificial Sequence
  Description of Artificial Sequence: Synthetic peptide
LWCGDASLGQLCWL

SEQ ID NO: 72 - protein, 14 aa, Artificial Sequence
  Description of Artificial Sequence: Synthetic peptide
LDCFYATLGQVCSL

SEQ ID NO: 73 - protein, 14 aa, Artificial Sequence
  Description of Artificial Sequence: Synthetic peptide
LPCSLAKLHELCDI

SEQ ID NO: 74 - protein, 14 aa, Artificial Sequence
  Description of Artificial Sequence: Synthetic peptide
LSCSDAQLMQLCEI

SEQ ID NO: 75 - protein, 14 aa, Artificial Sequence
  Description of Artificial Sequence: Synthetic peptide
MECFLAAVGQICEL

SEQ ID NO: 76 - protein, 14 aa, Artificial Sequence
  Description of Artificial Sequence: Synthetic peptide
MFCQTAEVGQMCLL

SEQ ID NO: 77 - protein, 14 aa, Artificial Sequence
  Description of Artificial Sequence: Synthetic peptide
MLCWEAPVGDVCTI

SEQ ID NO: 78 - protein, 14 aa, Artificial Sequence
  Description of Artificial Sequence: Synthetic peptide
MDCSDAHVGQICSI

SEQ ID NO: 79 - protein, 8 aa, Artificial Sequence
  Description of Artificial Sequence: Synthetic peptide
MMSSLGDL

SEQ ID NO: 80 - protein, 14 aa, Artificial Sequence
  Description of Artificial Sequence: Synthetic peptide
NFCSGAGLGELCVI

SEQ ID NO: 81 - protein, 14 aa, Artificial Sequence
  Description of Artificial Sequence: Synthetic peptide
NLCEYSKVGEVCVF

SEQ ID NO: 82 - protein, 14 aa, Artificial Sequence
  Description of Artificial Sequence: Synthetic peptide
NYCYQALLDTYCIL

SEQ ID NO: 83 - protein, 8 aa, Artificial Sequence
  Description of Artificial Sequence: Synthetic peptide
NLAQIGDL

SEQ ID NO: 84 - protein, 14 aa, Artificial Sequence
  Description of Artificial Sequence: Synthetic peptide
PDCWYAGLGQICEF

SEQ ID NO: 85 - protein, 14 aa, Artificial Sequence
  Description of Artificial Sequence: Synthetic peptide
PSCWMAQVGDLCFI

SEQ ID NO: 86 - protein, 14 aa, Artificial Sequence
  Description of Artificial Sequence: Synthetic peptide
PTCDTAAVGDLCEF

SEQ ID NO: 87 - protein, 14 aa, Artificial Sequence
  Description of Artificial Sequence: Synthetic peptide
PDCSVALLGESCSV

SEQ ID NO: 88 - protein, 14 aa, Artificial Sequence
  Description of Artificial Sequence: Synthetic peptide
PDCSEALLGQICTY

SEQ ID NO: 89 - protein, 14 aa, Artificial Sequence
  Description of Artificial Sequence: Synthetic peptide
QDCSSASVGTICYL

SEQ ID NO: 90 - protein, 14 aa, Artificial Sequence
  Description of Artificial Sequence: Synthetic peptide
QECGVWDLWPDCWI

SEQ ID NO: 91 - protein, 14 aa, Artificial Sequence
  Description of Artificial Sequence: Synthetic peptide
QDCFQAPIGSLCYL

SEQ ID NO: 92 - protein, 14 aa, Artificial Sequence
  Description of Artificial Sequence: Synthetic peptide
QWCYMTDVGDLCEL

SEQ ID NO: 93 - protein, 14 aa, Artificial Sequence
  Description of Artificial Sequence: Synthetic peptide
QACEVAKVGELCDL

SEQ ID NO: 94 - protein, 8 aa, Artificial Sequence
  Description of Artificial Sequence: Synthetic peptide
QTAELGDL

SEQ ID NO: 95 - protein, 8 aa, Artificial Sequence
  Description of Artificial Sequence: Synthetic peptide
QIAMIGEY

SEQ ID NO: 96 - protein, 8 aa, Artificial Sequence
  Description of Artificial Sequence: Synthetic peptide
QQAKLGEL

SEQ ID NO: 97 - protein, 8 aa, Artificial Sequence
  Description of Artificial Sequence: Synthetic peptide
QFARLGQT

SEQ ID NO: 98 - protein, 8 aa, Artificial Sequence
  Description of Artificial Sequence: Synthetic peptide
QVASLGDY

SEQ ID NO: 99 - protein, 8 aa, Artificial Sequence
  Description of Artificial Sequence: Synthetic peptide
QDAQIGDV

SEQ ID NO: 100 - protein, 8 aa, Artificial Sequence
  Description of Artificial Sequence: Synthetic peptide
QTAEVGQM

SEQ ID NO: 101 - protein, 8 aa, Artificial Sequence
  Description of Artificial Sequence: Synthetic peptide
QVGDFWDV

SEQ ID NO: 102 - protein, 8 aa, Artificial Sequence
  Description of Artificial Sequence: Synthetic peptide
QAAQVGQL

SEQ ID NO: 103 - protein, 8 aa, Artificial Sequence
  Description of Artificial Sequence: Synthetic peptide
QNAPLGSY

SEQ ID NO: 104 - protein, 8 aa, Artificial Sequence
  Description of Artificial Sequence: Synthetic peptide
RNSNVGDV

SEQ ID NO: 105 - protein, 8 aa, Artificial Sequence
  Description of Artificial Sequence: Synthetic peptide
RYAEVGVL

SEQ ID NO: 106 - protein, 8 aa, Artificial Sequence
  Description of Artificial Sequence: Synthetic peptide
RIAQVGEL

SEQ ID NO: 107 - protein, 14 aa, Artificial Sequence
  Description of Artificial Sequence: Synthetic peptide
SDCHLAQVGEFCFL

SEQ ID NO: 108 - protein, 14 aa, Artificial Sequence
  Description of Artificial Sequence: Synthetic peptide
SDCYLSQVGSLCDF

SEQ ID NO: 109 - protein, 14 aa, Artificial Sequence
  Description of Artificial Sequence: Synthetic peptide
SPCSEASLFQLCDL

SEQ ID NO: 110 - protein, 14 aa, Artificial Sequence
  Description of Artificial Sequence: Synthetic peptide
SWCQVGDFWDVCTS

SEQ ID NO: 111 - protein, 14 aa, Artificial Sequence
  Description of Artificial Sequence: Synthetic peptide
SGCEYATLGSLCDL

SEQ ID NO: 112 - protein, 14 aa, Artificial Sequence
  Description of Artificial Sequence: Synthetic peptide
SLCSLAPLGSLCDL

SEQ ID NO: 113 - protein, 14 aa, Artificial Sequence
  Description of Artificial Sequence: Synthetic peptide
SLCSMVGLGQLCDL

SEQ ID NO: 114 - protein, 8 aa, Artificial Sequence
  Description of Artificial Sequence: Synthetic peptide
SSASVGTI

SEQ ID NO: 115 - protein, 8 aa, Artificial Sequence
  Description of Artificial Sequence: Synthetic peptide
STAQVGEL

SEQ ID NO: 116 - protein, 8 aa, Artificial Sequence
  Description of Artificial Sequence: Synthetic peptide
SDAAVGAL

SEQ ID NO: 117 - protein, 8 aa, Artificial Sequence
  Description of Artificial Sequence: Synthetic peptide
SIAQLFSL

SEQ ID NO: 118 - protein, 8 aa, Artificial Sequence
  Description of Artificial Sequence: Synthetic peptide
SQAPLGTL

SEQ ID NO: 119 - protein, 8 aa, Artificial Sequence
  Description of Artificial Sequence: Synthetic peptide
SLSSLGDY

SEQ ID NO: 120 - protein, 8 aa, Artificial Sequence
  Description of Artificial Sequence: Synthetic peptide
SGAGLGEL

SEQ ID NO: 121 - protein, 8 aa, Artificial Sequence
  Description of Artificial Sequence: Synthetic peptide
SEASLFQL

SEQ ID NO: 122 - protein, 8 aa, Artificial Sequence
  Description of Artificial Sequence: Synthetic peptide
SSVQVGEL

SEQ ID NO: 123 - protein, 8 aa, Artificial Sequence
  Description of Artificial Sequence: Synthetic peptide
SEALLGQI

SEQ ID NO: 124 - protein, 8 aa, Artificial Sequence
  Description of Artificial Sequence: Synthetic peptide
SRAVVGEL

SEQ ID NO: 125 - protein, 8 aa, Artificial Sequence
  Description of Artificial Sequence: Synthetic peptide
SVALLGES

SEQ ID NO: 126 - protein, 8 aa, Artificial Sequence
  Description of Artificial Sequence: Synthetic peptide
SLARLGEY

SEQ ID NO: 127 - protein, 8 aa, Artificial Sequence
  Description of Artificial Sequence: Synthetic peptide
SDAHVGQI

SEQ ID NO: 128 - protein, 8 aa, Artificial Sequence
  Description of Artificial Sequence: Synthetic peptide
SEAQIGQL

SEQ ID NO: 129 - protein, 8 aa, Artificial Sequence
  Description of Artificial Sequence: Synthetic peptide
SEALLGQI

SEQ ID NO: 130 - protein, 8 aa, Artificial Sequence
  Description of Artificial Sequence: Synthetic peptide
SLAPLGSL

SEQ ID NO: 131 - protein, 8 aa, Artificial Sequence
  Description of Artificial Sequence: Synthetic peptide
SMVGLGQL

SEQ ID NO: 132 - protein, 8 aa, Artificial Sequence
  Description of Artificial Sequence: Synthetic peptide
SVARVGWL

SEQ ID NO: 133 - protein, 8 aa, Artificial Sequence
  Description of Artificial Sequence: Synthetic peptide
SLAKLHEL

SEQ ID NO: 134 - protein, 8 aa, Artificial Sequence
  Description of Artificial Sequence: Synthetic peptide
SDAQLMQL

SEQ ID NO: 135 - protein, 14 aa, Artificial Sequence
  Description of Artificial Sequence: Synthetic peptide
TECWLQALGELCDF

SEQ ID NO: 136 - protein, 14 aa, Artificial Sequence
  Description of Artificial Sequence: Synthetic peptide
TGCNLAQIGDLCDL

SEQ ID NO: 137 - protein, 14 aa, Artificial Sequence
  Description of Artificial Sequence: Synthetic peptide
TGCWQAPVGSLCEL

SEQ ID NO: 138 - protein, 8 aa, Artificial Sequence
  Description of Artificial Sequence: Synthetic peptide
TRASLGDI

SEQ ID NO: 139 - protein, 14 aa, Artificial Sequence
  Description of Artificial Sequence: Synthetic peptide
VACSSVQVGELCDF

SEQ ID NO: 140 - protein, 14 aa, Artificial Sequence
  Description of Artificial Sequence: Synthetic peptide
VECMMSSLGDLCSF

SEQ ID NO: 141 - protein, 14 aa, Artificial Sequence
  Description of Artificial Sequence: Synthetic peptide
VNCWEAQVGWLCDW

SEQ ID NO: 142 - protein, 14 aa, Artificial Sequence
  Description of Artificial Sequence: Synthetic peptide
VTCDKATVGQMCSI

SEQ ID NO: 143 - protein, 14 aa, Artificial Sequence
  Description of Artificial Sequence: Synthetic peptide
VDCSRAVVGELCVN

SEQ ID NO: 144 - protein, 14 aa, Artificial Sequence
  Description of Artificial Sequence: Synthetic peptide
WSCDVASVGSYCML

SEQ ID NO: 145 - protein, 8 aa, Artificial Sequence
  Description of Artificial Sequence: Synthetic peptide
WEAPVGEI

SEQ ID NO: 146 - protein, 8 aa, Artificial Sequence
  Description of Artificial Sequence: Synthetic peptide
WEAPVGDV

SEQ ID NO: 147 - protein, 8 aa, Artificial Sequence
  Description of Artificial Sequence: Synthetic peptide
WYAGLGQI

SEQ ID NO: 148 - protein, 8 aa, Artificial Sequence
  Description of Artificial Sequence: Synthetic peptide
WMAQVGDL

SEQ ID NO: 149 - protein, 8 aa, Artificial Sequence
  Description of Artificial Sequence: Synthetic peptide
WLQALGEL

SEQ ID NO: 150 - protein, 8 aa, Artificial Sequence
  Description of Artificial Sequence: Synthetic peptide
WEAQVGWL

SEQ ID NO: 151 - protein, 8 aa, Artificial Sequence
  Description of Artificial Sequence: Synthetic peptide
WQAQKGDL

SEQ ID NO: 152 - protein, 8 aa, Artificial Sequence
  Description of Artificial Sequence: Synthetic peptide
WQAPVGSL

SEQ ID NO: 153 - protein, 14 aa, Artificial Sequence
  Description of Artificial Sequence: Synthetic peptide
  MOD_RES (1)..(1): Any amino acid
XDCSEALLGQICTY

SEQ ID NO: 154 - protein, 14 aa, Artificial Sequence
  Description of Artificial Sequence: Synthetic peptide
YDCRIAQVGELCDL

SEQ ID NO: 155 - protein, 14 aa, Artificial Sequence
  Description of Artificial Sequence: Synthetic peptide
YECFQAQVGQLCDV

SEQ ID NO: 156 - protein, 8 aa, Artificial Sequence
  Description of Artificial Sequence: Synthetic peptide
YLIGQDEF

SEQ ID NO: 157 - protein, 8 aa, Artificial Sequence
  Description of Artificial Sequence: Synthetic peptide
YFSQIGEL

SEQ ID NO: 158 - protein, 8 aa, Artificial Sequence
  Description of Artificial Sequence: Synthetic peptide
YLAELGQV

SEQ ID NO: 159 - protein, 8 aa, Artificial Sequence
  Description of Artificial Sequence: Synthetic peptide
YLAVLGQL

SEQ ID NO: 160 - protein, 8 aa, Artificial Sequence
  Description of Artificial Sequence: Synthetic peptide
YQALLDTY

SEQ ID NO: 161 - protein, 8 aa, Artificial Sequence
  Description of Artificial Sequence: Synthetic peptide
YMTDVGDL

SEQ ID NO: 162 - protein, 8 aa, Artificial Sequence
  Description of Artificial Sequence: Synthetic peptide
YLSQVGSL

SEQ ID NO: 163 - protein, 8 aa, Artificial Sequence
  Description of Artificial Sequence: Synthetic peptide
YAAVLNSL

SEQ ID NO: 164 - protein, 8 aa, Artificial Sequence
  Description of Artificial Sequence: Synthetic peptide
YQAMVGDL

SEQ ID NO: 165 - protein, 8 aa, Artificial Sequence
  Description of Artificial Sequence: Synthetic peptide
  MOD_RES (1)..(1): Any amino acid
  MOD_RES (2)..(2): Any amino acid comprising a large hydrophobic side chain
  MOD_RES (3)..(3): Any amino acid comprising a small hydrophobic side chain
  MOD_RES (4)..(4): Any amino acid
  MOD_RES (5)..(5): Any amino acid
  MOD_RES (6)..(6): Any amino acid comprising a large hydrophobic side chain
  MOD_RES (7)..(7): Any amino acid comprising a small hydrophobic side chain
  MOD_RES (8)..(8): Any amino acid
XXXXXXXX

SEQ ID NO: 166 - protein, 10 aa, Artificial Sequence
  Description of Artificial Sequence: Synthetic peptide
  MOD_RES (2)..(2): Any amino acid
  MOD_RES (3)..(3): Any amino acid comprising a large hydrophobic side chain
  MOD_RES (4)..(4): Any amino acid comprising a small hydrophobic side chain
  MOD_RES (5)..(5): Any amino acid
  MOD_RES (6)..(6): Any amino acid
  MOD_RES (7)..(7): Any amino acid comprising a large hydrophobic side chain
  MOD_RES (8)..(8): Any amino acid comprising a small hydrophobic side chain
  MOD_RES (9)..(9): Any amino acid
CXXXXXXXXC

SEQ ID NO: 167 - protein, 12 aa, Artificial Sequence
  Description of Artificial Sequence: Synthetic peptide
  MOD_RES (1)..(1): Any amino acid comprising a large hydrophobic side chain
  MOD_RES (3)..(3): Any amino acid
  MOD_RES (4)..(4): Any amino acid comprising a large hydrophobic side chain
  MOD_RES (5)..(5): Any amino acid comprising a small hydrophobic side chain
  MOD_RES (6)..(6): Any amino acid
  MOD_RES (7)..(7): Any amino acid
  MOD_RES (8)..(8): Any amino acid comprising a large hydrophobic side chain
  MOD_RES (9)..(9): Any amino acid comprising a small hydrophobic side chain
  MOD_RES (10)..(10): Any amino acid
  MOD_RES (12)..(12): Any amino acid
XCXXXXXXXXCX

SEQ ID NO: 168 - protein, 14 aa, Artificial Sequence
  Description of Artificial Sequence: Synthetic peptide
  MOD_RES (1)..(1): Any amino acid
  MOD_RES (2)..(2): Any amino acid comprising a large hydrophobic side chain
  MOD_RES (4)..(4): Any amino acid
  MOD_RES (5)..(5): Any amino acid comprising a large hydrophobic side chain
  MOD_RES (6)..(6): Any amino acid comprising a small hydrophobic side chain
  MOD_RES (7)..(7): Any amino acid
  MOD_RES (8)..(8): Any amino acid
  MOD_RES (9)..(9): Any amino acid comprising a large hydrophobic side chain
  MOD_RES (10)..(10): Any amino acid comprising a small hydrophobic side chain
  MOD_RES (11)..(11): Any amino acid
  MOD_RES (13)..(13): Any amino acid
  MOD_RES (14)..(14): Any amino acid comprising a large hydrophobic side chain
XXCXXXXXXXXCXX

SEQ ID NO: 169 - protein, 14 aa, Artificial Sequence
  Description of Artificial Sequence: Synthetic peptide
AECGVGAIWPSCLW

SEQ ID NO: 170 - protein, 14 aa, Artificial Sequence
  Description of Artificial Sequence: Synthetic peptide
DFCLVGDLWPSCWL

SEQ ID NO: 171 - protein, 8 aa, Artificial Sequence
  Description of Artificial Sequence: Synthetic peptide
DVGQWWPD

SEQ ID NO: 172 - protein, 8 aa, Artificial Sequence
  Description of Artificial Sequence: Synthetic peptide
DYMNSDYQ

SEQ ID NO: 173 - protein, 8 aa, Artificial Sequence
  Description of Artificial Sequence: Synthetic peptide
DLFAIWPD

SEQ ID NO: 174 - protein, 14 aa, Artificial Sequence
  Description of Artificial Sequence: Synthetic peptide
EICNVGQVWPDCLL

SEQ ID NO: 175 - protein, 14 aa, Artificial Sequence
  Description of Artificial Sequence: Synthetic peptide
GQCLPGDFWPACYE

SEQ ID NO: 176 - protein, 8 aa, Artificial Sequence
  Description of Artificial Sequence: Synthetic peptide
GVGAIWPS

SEQ ID NO: 177 - protein, 8 aa, Artificial Sequence
  Description of Artificial Sequence: Synthetic peptide
LPGDFWPA

SEQ ID NO: 178 - protein, 8 aa, Artificial Sequence
  Description of Artificial Sequence: Synthetic peptide
LVGDYWPS

SEQ ID NO: 179 - protein, 8 aa, Artificial Sequence
  Description of Artificial Sequence: Synthetic peptide
LVGDLWPS

SEQ ID NO: 180 - protein, 14 aa, Artificial Sequence
  Description of Artificial Sequence: Synthetic peptide
NMCLVGDYWPSCQI

SEQ ID NO: 181 - protein, 8 aa, Artificial Sequence
  Description of Artificial Sequence: Synthetic peptide
NVGQVWPD

SEQ ID NO: 182 - protein, 14 aa, Artificial Sequence
  Description of Artificial Sequence: Synthetic peptide
QICDVGQWWPDCQV

SEQ ID NO: 183 - protein, 14 aa, Artificial Sequence
  Description of Artificial Sequence: Synthetic peptide
RLCDLFAIWPDCLF

SEQ ID NO: 184 - protein, 14 aa, Artificial Sequence
  Description of Artificial Sequence: Synthetic peptide
VLCDYMNSDYQCIT

SEQ ID NO: 185 - protein, 10 aa, Artificial Sequence
  Description of Artificial Sequence: Synthetic peptide
  MOD_RES (1)..(1): Any amino acid
  MOD_RES (2)..(2): Any amino acid comprising a large hydrophobic side chain
  MOD_RES (3)..(3): Any amino acid comprising a small hydrophobic side chain
  MOD_RES (4)..(4): Any amino acid comprising an acidic side chain or a polar neutral side chain
  MOD_RES (5)..(5): Any amino acid
  MOD_RES (6)..(6): Any amino acid
  MOD_RES (7)..(7): Any amino acid comprising a polar-neutral side chain or an acidic side chain
  MOD_RES (8)..(8): Any amino acid
  MOD_RES (9)..(9): Any amino acid
  MOD_RES (10)..(10): Any amino acid
XXXXXXXXXX

SEQ ID NO: 186 - protein, 12 aa, Artificial Sequence
  Description of Artificial Sequence: Synthetic peptide
  MOD_RES (2)..(2): Any amino acid
  MOD_RES (3)..(3): Any amino acid comprising a large hydrophobic side chain
  MOD_RES (4)..(4): Any amino acid comprising a small hydrophobic side chain
  MOD_RES (5)..(5): Any amino acid comprising an acidic side chain or a polar neutral side chain
  MOD_RES (6)..(6): Any amino acid
  MOD_RES (7)..(7): Any amino acid
  MOD_RES (8)..(8): Any amino acid comprising a polar-neutral side chain or an acidic side chain
  MOD_RES (9)..(9): Any amino acid
  MOD_RES (10)..(10): Any amino acid
  MOD_RES (11)..(11): Any amino acid
CXXXXXXXXXXC

SEQ ID NO: 187 - protein, 14 aa, Artificial Sequence
  Description of Artificial Sequence: Synthetic peptide
  MOD_RES (1)..(1): Any amino acid
  MOD_RES (3)..(3): Any amino acid
  MOD_RES (4)..(4): Any amino acid comprising a large hydrophobic side chain
  MOD_RES (5)..(5): Any amino acid comprising a small hydrophobic side chain
  MOD_RES (6)..(6): Any amino acid comprising an acidic side chain or a polar neutral side chain
  MOD_RES (7)..(7): Any amino acid
  MOD_RES (8)..(8): Any amino acid
  MOD_RES (9)..(9): Any amino acid comprising a polar-neutral side chain or an acidic side chain
  MOD_RES (10)..(10): Any amino acid
  MOD_RES (11)..(11): Any amino acid
  MOD_RES (12)..(12): Any amino acid
  MOD_RES (14)..(14): Any amino acid
XCXXXXXXXXXXCX

SEQ ID NO: 188 - protein, 14 aa, Artificial Sequence
  Description of Artificial Sequence: Synthetic peptide
CVLLEHSSVGDIIC

SEQ ID NO: 189 - protein, 14 aa, Artificial Sequence
  Description of Artificial Sequence: Synthetic peptide
LCHVGDYIQDGICM

SEQ ID NO: 190 - protein, 14 aa, Artificial Sequence
  Description of Artificial Sequence: Synthetic peptide
LCHVGDYIQDGICM

SEQ ID NO: 191 - protein, 14 aa, Artificial Sequence
  Description of Artificial Sequence: Synthetic peptide
SCQIGELVDLTDCA

SEQ ID NO: 192 - protein, 14 aa, Artificial Sequence
  Description of Artificial Sequence: Synthetic peptide
SCQIGELVDLTDCA

SEQ ID NO: 193 - protein, 14 aa, Artificial Sequence
  Description of Artificial Sequence: Synthetic peptide
TCQVGDFFDWLSCA

SEQ ID NO: 194 - protein, 14 aa, Artificial Sequence
  Description of Artificial Sequence: Synthetic peptide
TCQVGDFFDWLSCA

SEQ ID NO: 195 - protein, 13 aa, Artificial Sequence
  Description of Artificial Sequence: Synthetic peptide
YACAENVIDWLCT

SEQ ID NO: 196 - protein, 13 aa, Artificial Sequence
  Description of Artificial Sequence: Synthetic peptide
YACAENVIDWLCT

SEQ ID NO: 197 - protein, 12 aa, Artificial Sequence
  Description of Artificial Sequence: Synthetic peptide
  MOD_RES (1)..(1): Any amino acid
  MOD_RES (2)..(2): Any amino acid
  MOD_RES (3)..(3): Any amino acid comprising an acidic side chain
  MOD_RES (4)..(4): Any amino acid comprising a large hydrophobic side chain
  MOD_RES (5)..(5): Any amino acid comprising a small hydrophobic side chain
  MOD_RES (6)..(6): Any amino acid comprising an acidic side chain
  MOD_RES (7)..(7): Any amino acid comprising a large hydrophobic side chain
  MOD_RES (8)..(8): Any amino acid
  MOD_RES (9)..(9): Any amino acid comprising an acidic side chain
  MOD_RES (10)..(10): Any amino acid
  MOD_RES (11)..(11): Any amino acid
  MOD_RES (12)..(12): Any amino acid comprising a large hydrophobic side chain
XXXXXXXXXXXX

SEQ ID NO: 198 - protein, 10 aa, Artificial Sequence
  Description of Artificial Sequence: Synthetic peptide
CQSVGDWCDM

SEQ ID NO: 199 - protein, 11 aa, Artificial Sequence
  Description of Artificial Sequence: Synthetic peptide
CDAVGSWCDFC

SEQ ID NO: 200 - protein, 10 aa, Artificial Sequence
  Description of Artificial Sequence: Synthetic peptide
CFTVGDYCGY

SEQ ID NO: 201 - protein, 10 aa, Artificial Sequence
  Description of Artificial Sequence: Synthetic peptide
CYEVGDYCQS

SEQ ID NO: 202 - protein, 10 aa, Artificial Sequence
  Description of Artificial Sequence: Synthetic peptide
CGMAIGDLCM

SEQ ID NO: 203 - protein, 12 aa, Artificial Sequence
  Description of Artificial Sequence: Synthetic peptide
CLEVGCIWDMFV

SEQ ID NO: 204 - protein, 12 aa, Artificial Sequence
  Description of Artificial Sequence: Synthetic peptide
CYEVGDYCQSPL

SEQ ID NO: 205 - protein, 13 aa, Artificial Sequence
  Description of Artificial Sequence: Synthetic peptide
DCMLYELCDIDVL

SEQ ID NO: 206 - protein, 12 aa, Artificial Sequence
  Description of Artificial Sequence: Synthetic peptide
FCDMGTVWPDLS

SEQ ID NO: 207 - protein, 13 aa, Artificial Sequence
  Description of Artificial Sequence: Synthetic peptide
FLVCDDHYCWLWT

SEQ ID NO: 208 - protein, 13 aa, Artificial Sequence
  Description of Artificial Sequence: Synthetic peptide
RWGDVGDLLMPFL

SEQ ID NO: 209 - protein, 12 aa, Artificial Sequence
  Description of Artificial Sequence: Synthetic peptide
RWGDVGDLLMPL

SEQ ID NO: 210 - protein, 11 aa, Artificial Sequence
  Description of Artificial Sequence: Synthetic peptide
SCCVGDIWDTF

SEQ ID NO: 211 - protein, 11 aa, Artificial Sequence
  Description of Artificial Sequence: Synthetic peptide
WCSDIGQYCDY

SEQ ID NO: 212 - protein, 15 aa, Artificial Sequence
  Description of Artificial Sequence: Synthetic peptide
WESWNVGDLVNLVNW

SEQ ID NO: 213 - protein, 15 aa, Artificial Sequence
  Description of Artificial Sequence: Synthetic peptide
  MOD_RES (4)..(4): Any amino acid
ASCXWLVSFGRSVCL

SEQ ID NO: 214 - protein, 14 aa, Artificial Sequence
  Description of Artificial Sequence: Synthetic peptide
CLSIGFRDICFYRV

SEQ ID NO: 215 - protein, 13 aa, Artificial Sequence
  Description of Artificial Sequence: Synthetic peptide
DCMLYELCDIDVL

SEQ ID NO: 216 - protein, 13 aa, Artificial Sequence
  Description of Artificial Sequence: Synthetic peptide
FLVCDDHYCWLWT

SEQ ID NO: 217 - protein, 14 aa, Artificial Sequence
  Description of Artificial Sequence: Synthetic peptide
ICYYSPSDNTTVCE

SEQ ID NO: 218 - protein, 14 aa, Artificial Sequence
  Description of Artificial Sequence: Synthetic peptide
ICYYSPSDNTTVCE

SEQ ID NO: 219 - protein, 14 aa, Artificial Sequence
  Description of Artificial Sequence: Synthetic peptide
RSCYYKRPRLWCSE

SEQ ID NO: 220 - protein, 20 aa, Artificial Sequence
  Description of Artificial Sequence: Synthetic peptide
  MOD_RES (1)..(1): Any amino acid comprising a large hydrophobic side chain or an aromatic side chain
  MOD_RES (2)..(2): Any amino acid
  MOD_RES (3)..(3): Any amino acid comprising a large hydrophobic side chain or an aromatic side chain
  MOD_RES (4)..(4): Any amino acid comprising a large hydrophobic side chain or a basic side chain
  MOD_RES (5)..(5): Any amino acid comprising an acidic side chain or a small hydrophobic side chain
  MOD_RES (7)..(7): Any amino acid comprising a large hydrophobic side chain or a basic side chain
  MOD_RES (8)..(8): Any amino acid comprising a large hydrophobic side chain
  MOD_RES (9)..(9): Any amino acid comprising a small hydrophobic side chain
  MOD_RES (10)..(10): Any amino acid comprising a polar/neutral side chain or a basic side chain
  MOD_RES (11)..(11): Any amino acid comprising a large hydrophobic side chain
  MOD_RES (12)..(12): Any amino acid comprising a small hydrophobic side chain
  MOD_RES (13)..(13): Any amino acid comprising an acidic side chain or a polar/neutral side chain
  MOD_RES (14)..(14): Any amino acid comprising a large hydrophobic side chain
  MOD_RES (16)..(16): Any amino acid comprising an acidic side chain
  MOD_RES (17)..(17): Any amino acid comprising a large hydrophobic side chain
  MOD_RES (18)..(18): Any amino acid comprising an acidic side chain or an aromatic side chain
  MOD_RES (19)..(19): Any amino acid comprising an amino acid
  MOD_RES (20)..(20): Any amino acid comprising an acidic side chain
XXXXXCXXXXXXXXCXXXXX

SEQ ID NO: 221 - protein, 18 aa, Artificial Sequence
  Description of Artificial Sequence: Synthetic peptide
  MOD_RES (1)..(1): Any amino acid
  MOD_RES (2)..(2): Any amino acid comprising a large hydrophobic side chain or an aromatic side chain
  MOD_RES (3)..(3): Any amino acid comprising a large hydrophobic side chain or a basic side chain
  MOD_RES (4)..(4): Any amino acid comprising an acidic side chain or a small hydrophobic side chain
  MOD_RES (6)..(6): Any amino acid comprising a large hydrophobic side chain or a basic side chain
  MOD_RES (7)..(7): Any amino acid comprising a large hydrophobic side chain
  MOD_RES (8)..(8): Any amino acid comprising a small hydrophobic side chain
  MOD_RES (9)..(9): Any amino acid comprising a polar/neutral side chain or a basic side chain
  MOD_RES (10)..(10): Any amino acid comprising a large hydrophobic side chain
  MOD_RES (11)..(11): Any amino acid comprising a small hydrophobic side chain
  MOD_RES (12)..(12): Any amino acid comprising an acidic side chain or a polar/neutral side chain
  MOD_RES (13)..(13): Any amino acid comprising a large hydrophobic side chain
  MOD_RES (15)..(15): Any amino acid comprising an acidic side chain
  MOD_RES (16)..(16): Any amino acid comprising a large hydrophobic side chain
  MOD_RES (17)..(17): Any amino acid comprising an acidic side chain or an aromatic side chain
  MOD_RES (18)..(18): Any amino acid comprising an amino acid
XXXXCXXXXXXXXCXXXX

SEQ ID NO: 222 - protein, 16 aa, Artificial Sequence
  Description of Artificial Sequence: Synthetic peptide
  MOD_RES (1)..(1): Any amino acid comprising a large hydrophobic side chain or an aromatic side chain
  MOD_RES (2)..(2): Any amino acid comprising a large hydrophobic side chain or a basic side chain
  MOD_RES (3)..(3): Any amino acid comprising an acidic side chain or a small hydrophobic side chain
  MOD_RES (5)..(5): Any amino acid comprising a large hydrophobic side chain or a basic side chain
  MOD_RES (6)..(6): Any amino acid comprising a large hydrophobic side chain
  MOD_RES (7)..(7): Any amino acid comprising a small hydrophobic side chain
  MOD_RES (8)..(8): Any amino acid comprising a polar/neutral side chain or a basic side chain
  MOD_RES (9)..(9): Any amino acid comprising a large hydrophobic side chain
  MOD_RES (10)..(10): Any amino acid comprising a small hydrophobic side chain
  MOD_RES (11)..(11): Any amino acid comprising an acidic side chain or a polar/neutral side chain
  MOD_RES (12)..(12): Any amino acid comprising a large hydrophobic side chain
  MOD_RES (14)..(14): Any amino acid comprising an acidic side chain
  MOD_RES (15)..(15): Any amino acid comprising a large hydrophobic side chain
  MOD_RES (16)..(16): Any amino acid comprising an acidic side chain or an aromatic side chain
XXXCXXXXXXXXCXXX

SEQ ID NO: 223 - protein, 14 aa, Artificial Sequence
  Description of Artificial Sequence: Synthetic peptide
  MOD_RES (1)..(1): Any amino acid comprising a large hydrophobic side chain or a basic side chain
  MOD_RES (2)..(2): Any amino acid comprising an acidic side chain or a small hydrophobic side chain
  MOD_RES (4)..(4): Any amino acid comprising a large hydrophobic side chain or a basic side chain
  MOD_RES (5)..(5): Any amino acid comprising a large hydrophobic side chain
  MOD_RES (6)..(6): Any amino acid comprising a small hydrophobic side chain
  MOD_RES (7)..(7): Any amino acid comprising a polar/neutral side chain or a basic side chain
  MOD_RES (8)..(8): Any amino acid comprising a large hydrophobic side chain
  MOD_RES (9)..(9): Any amino acid comprising a small hydrophobic side chain
  MOD_RES (10)..(10): Any amino acid comprising an acidic side chain or a polar/neutral side chain
  MOD_RES (11)..(11): Any amino acid comprising a large hydrophobic side chain
  MOD_RES (13)..(13): Any amino acid comprising an acidic side chain
  MOD_RES (14)..(14): Any amino acid comprising a large hydrophobic side chain
XXCXXXXXXXXCXX

SEQ ID NO: 224 - protein, 12 aa, Artificial Sequence
  Description of Artificial Sequence: Synthetic peptide
  MOD_RES (1)..(1): Any amino acid comprising an acidic side chain or a small hydrophobic side chain
  MOD_RES (3)..(3): Any amino acid comprising a large hydrophobic side chain or a basic side chain
  MOD_RES (4)..(4): Any amino acid comprising a large hydrophobic side chain
  MOD_RES (5)..(5): Any amino acid comprising a small hydrophobic side chain
  MOD_RES (6)..(6): Any amino acid comprising a polar/neutral side chain or a basic side chain
  MOD_RES (7)..(7): Any amino acid comprising a large hydrophobic side chain
  MOD_RES (8)..(8): Any amino acid comprising a small hydrophobic side chain
  MOD_RES (9)..(9): Any amino acid comprising an acidic side chain or a polar/neutral side chain
  MOD_RES (10)..(10): Any amino acid comprising a large hydrophobic side chain
  MOD_RES (12)..(12): Any amino acid comprising an acidic side chain
XCXXXXXXXXCX

SEQ ID NO: 225 - protein, 11 aa, Artificial Sequence
  Description of Artificial Sequence: Synthetic peptide
  MOD_RES (2)..(2): Any amino acid comprising a large hydrophobic side chain or a basic side chain
  MOD_RES (3)..(3): Any amino acid comprising a large hydrophobic side chain
  MOD_RES (4)..(4): Any amino acid comprising a small hydrophobic side chain
  MOD_RES (5)..(5): Any amino acid comprising a polar/neutral side chain or a basic side chain
  MOD_RES (6)..(6): Any amino acid comprising a large hydrophobic side chain
  MOD_RES (7)..(7): Any amino acid comprising a small hydrophobic side chain
  MOD_RES (8)..(8): Any amino acid comprising an acidic side chain or a polar/neutral side chain
  MOD_RES (9)..(9): Any amino acid comprising a large hydrophobic side chain
  MOD_RES (11)..(11): Any amino acid comprising an acidic side chain
CXXXXXXXXCX

SEQ ID NO: 226 - protein, 10 aa, Artificial Sequence
  Description of Artificial Sequence: Synthetic peptide
  MOD_RES (2)..(2): Any amino acid comprising a large hydrophobic side chain or a basic side chain
  MOD_RES (3)..(3): Any amino acid comprising a large hydrophobic side chain
  MOD_RES (4)..(4): Any amino acid comprising a small hydrophobic side chain
  MOD_RES (5)..(5): Any amino acid comprising a polar/neutral side chain or a basic side chain
  MOD_RES (6)..(6): Any amino acid comprising a large hydrophobic side chain
  MOD_RES (7)..(7): Any amino acid comprising a small hydrophobic side chain
  MOD_RES (8)..(8): Any amino acid comprising an acidic side chain or a polar/neutral side chain
  MOD_RES (9)..(9): Any amino acid comprising a large hydrophobic side chain
CXXXXXXXXC

SEQ ID NO: 227 - protein, 8 aa, Artificial Sequence
  Description of Artificial Sequence: Synthetic peptide
  MOD_RES (1)..(1): Any amino acid comprising a large hydrophobic side chain or a basic side chain
  MOD_RES (2)..(2): Any amino acid comprising a large hydrophobic side chain
  MOD_RES (3)..(3): Any amino acid comprising a small hydrophobic side chain
  MOD_RES (4)..(4): Any amino acid comprising a polar/neutral side chain or a basic side chain
  MOD_RES (5)..(5): Any amino acid comprising a large hydrophobic side chain
  MOD_RES (6)..(6): Any amino acid comprising a small hydrophobic side chain
  MOD_RES (7)..(7): Any amino acid comprising an acidic side chain or a polar/neutral side chain
  MOD_RES (8)..(8): Any amino acid comprising a large hydrophobic side chain
XXXXXXXX

SEQ ID NO: 228 - protein, 20 aa, Artificial Sequence
  Description of Artificial Sequence: Synthetic peptide
AQARFWHDCSIAHVGELCDL

SEQ ID NO: 229 - protein, 20 aa, Artificial Sequence
  Description of Artificial Sequence: Synthetic peptide
AVRNVWYDCSFARLHELCDV

SEQ ID NO: 230 - protein, 20 aa, Artificial Sequence
  Description of Artificial Sequence: Synthetic peptide
AGWHPCHLAQVGELCDLDAL

SEQ ID NO: 231 - protein, 20 aa, Artificial Sequence
  Description of Artificial Sequence: Synthetic peptide
AEVKPCHMAQVGDLCDLTGG

SEQ ID NO: 232 - protein, 20 aa, Artificial Sequence
  Description of Artificial Sequence: Synthetic peptide
AVWYDCRIAQVGELCDLVHP

SEQ ID NO: 233 - protein, 20 aa, Artificial Sequence
  Description of Artificial Sequence: Synthetic peptide
AYRAMPYYCWMAQLGELCDL

SEQ ID NO: 234 - protein, 20 aa, Artificial Sequence
  Description of Artificial Sequence: Synthetic peptide
ANFYDCRYAQLGELCDLMNV

SEQ ID NO: 235 - protein, 20 aa, Artificial Sequence
  Description of Artificial Sequence: Synthetic peptide
ALSWLWQDCALAQLGELCDL

SEQ ID NO: 236 - protein, 20 aa, Artificial Sequence
  Description of Artificial Sequence: Synthetic peptide
DVFKNWYDCRIAKLGELCDL

SEQ ID NO: 237 - protein, 20 aa, Artificial Sequence
  Description of Artificial Sequence: Synthetic peptide
DHLQRWWPCRLARLGELCDL

SEQ ID NO: 238 - protein, 20 aa, Artificial Sequence
  Description of Artificial Sequence: Synthetic peptide
DRFNPCHMAQLGELCDLARD

SEQ ID NO: 239 - protein, 20 aa, Artificial Sequence
  Description of Artificial Sequence: Synthetic peptide
DGHYECWKAQLGELCDLAGA

SEQ ID NO: 240 - protein, 20 aa, Artificial Sequence
  Description of Artificial Sequence: Synthetic peptide
DSNAPWYDCSKALLGELCDL

SEQ ID NO: 241 - protein, 20 aa, Artificial Sequence
  Description of Artificial Sequence: Synthetic peptide
EYVLKWPDCSSAQLGELCEL

SEQ ID NO: 242 - protein, 20 aa, Artificial Sequence
  Description of Artificial Sequence: Synthetic peptide
ESMGLGYPCWRAQLGELCDL

SEQ ID NO: 243 - protein, 20 aa, Artificial Sequence
  Description of Artificial Sequence: Synthetic peptide
ELVKTWYPCWKAHVGELCDL

SEQ ID NO: 244 - protein, 20 aa, Artificial Sequence
  Description of Artificial Sequence: Synthetic peptide
ESGHYIKHCSIALLGELCHL

SEQ ID NO: 245 - protein, 20 aa, Artificial Sequence
  Description of Artificial Sequence: Synthetic peptide
EVNWLYYDCRFAHLGELCDL

SEQ ID NO: 246 - protein, 20 aa, Artificial Sequence
  Description of Artificial Sequence: Synthetic peptide
ETVSDCRMAQVGELCEYHSA

SEQ ID NO: 247 - protein, 20 aa, Artificial Sequence
  Description of Artificial Sequence: Synthetic peptide
EYSLDCRIAQLGQLCDLMRW

SEQ ID NO: 248 - protein, 20 aa, Artificial Sequence
  Description of Artificial Sequence: Synthetic peptide
EPFYHCSIAQLGELCDLVRA

SEQ ID NO: 249 - protein, 20 aa, Artificial Sequence
  Description of Artificial Sequence: Synthetic peptide
FDCRFAQVGDLCDLWSPEHI

SEQ ID NO: 250 - protein, 14 aa, Artificial Sequence
  Description of Artificial Sequence: Synthetic peptide
FPCWLAKLGDLCDL

SEQ ID NO: 251 - protein, 20 aa, Artificial Sequence
  Description of Artificial Sequence: Synthetic peptide
FSFQHCHMAQLGELCDLGYE

SEQ ID NO: 252 - protein, 20 aa, Artificial Sequence
  Description of Artificial Sequence: Synthetic peptide
GRGVEYKECWMASLGELCTL

SEQ ID NO: 253 - protein, 20 aa, Artificial Sequence
  Description of Artificial Sequence: Synthetic peptide
GRADQVLPCWMAQLGELCEL

SEQ ID NO: 254 - protein, 20 aa, Artificial Sequence
  Description of Artificial Sequence: Synthetic peptide
GPSMTYKACWMAQLGELCEL

SEQ ID NO: 255 - protein, 20 aa, Artificial Sequence
  Description of Artificial Sequence: Synthetic peptide
GFLLEWYDCRIAQVGELCDL

SEQ ID NO: 256 - protein, 20 aa, Artificial Sequence
  Description of Artificial Sequence: Synthetic peptide
GDVYFCWNAKLGELCDLFEM

SEQ ID NO: 257 - protein, 20 aa, Artificial Sequence
  Description of Artificial Sequence: Synthetic peptide
GWHHWCHMAQVGELCDLQVT

SEQ ID NO: 258 - protein, 20 aa, Artificial Sequence
  Description of Artificial Sequence: Synthetic peptide
GLTLPCWMAQLGELCDLNNA

SEQ ID NO: 259 - protein, 20 aa, Artificial Sequence
  Description of Artificial Sequence: Synthetic peptide
GNFKQCHMAAVGELCEMENE

SEQ ID NO: 260 - protein, 20 aa, Artificial Sequence
  Description of Artificial Sequence: Synthetic peptide
GGMAKYNPCHIAKLGELCDL

SEQ ID NO: 261 - protein, 20 aa, Artificial Sequence
  Description of Artificial Sequence: Synthetic peptide
GVTYQWYDCSIALVGELCDI

SEQ ID NO: 262 - protein, 20 aa, Artificial Sequence
  Description of Artificial Sequence: Synthetic peptide
GSSVEIKPCWMAYLGELCHL

SEQ ID NO: 263 - protein, 20 aa, Artificial Sequence
  Description of Artificial Sequence: Synthetic peptide
GVFYDCRIAQLGELCDLWAS

SEQ ID NO: 264 - protein, 20 aa, Artificial Sequence
  Description of Artificial Sequence: Synthetic peptide
GFSHFCWEAQVGELCDLIYG

SEQ ID NO: 265 - protein, 20 aa, Artificial Sequence
  Description of Artificial Sequence: Synthetic peptide
GEWYDCRIAQVGELCDLWPV

SEQ ID NO: 266 - protein, 20 aa, Artificial Sequence
  Description of Artificial Sequence: Synthetic peptide
GDLVMFYDCRFARVGELCDL

SEQ ID NO: 267 - protein, 20 aa, Artificial Sequence
  Description of Artificial Sequence: Synthetic peptide
GSVWEFYDCFIARVGELCDL

SEQ ID NO: 268 - protein, 14 aa, Artificial Sequence
  Description of Artificial Sequence: Synthetic peptide
HPCWMAKVGELCDL

SEQ ID NO: 269 - protein, 20 aa, Artificial Sequence
  Description of Artificial Sequence: Synthetic peptide
HPCHMARLGELCDLHSGVYD

SEQ ID NO: 270 - protein, 20 aa, Artificial Sequence
  Description of Artificial Sequence: Synthetic peptide
HMFYPCWRAQVGELCDLANY

SEQ ID NO: 271 - protein, 14 aa, Artificial Sequence
  Description of Artificial Sequence: Synthetic peptide
HWCWMARLGELCDL

SEQ ID NO: 272 - protein, 20 aa, Artificial Sequence
  Description of Artificial Sequence: Synthetic peptide
HIMRTWYDCSIAQIGELCDL

SEQ ID NO: 273 - protein, 20 aa, Artificial Sequence
  Description of Artificial Sequence: Synthetic peptide
HPCHMAQVGELCDLNFPYVE

SEQ ID NO: 274 - protein, 14 aa, Artificial Sequence
  Description of Artificial Sequence: Synthetic peptide
IYCGFAPLGELCIL

SEQ ID NO: 275 - protein, 20 aa, Artificial Sequence
  Description of Artificial Sequence: Synthetic peptide
INQSVLWPCHLAAVGDLCDL

SEQ ID NO: 276 - protein, 20 aa, Artificial Sequence
  Description of Artificial Sequence: Synthetic peptide
IGYHACWMAQLGDLCDLHDN

SEQ ID NO: 277 - protein, 20 aa, Artificial Sequence
  Description of Artificial Sequence: Synthetic peptide
IKMSPCHLAQVGELCDLQWE

SEQ ID NO: 278 - protein, 20 aa, Artificial Sequence
  Description of Artificial Sequence: Synthetic peptide
ISGLGIYPCWMAHLGELCDL

SEQ ID NO: 279 - protein, 20 aa, Artificial Sequence
  Description of Artificial Sequence: Synthetic peptide
KLGKGWHDCSVAQVGELCDL

SEQ ID NO: 280 - protein, 20 aa, Artificial Sequence
  Description of Artificial Sequence: Synthetic peptide
KVKLSWYDCSVAQVGELCDL

SEQ ID NO: 281 - protein, 14 aa, Artificial Sequence
  Description of Artificial Sequence: Synthetic peptide
KWCWLAHLGELCDL

SEQ ID NO: 282 - protein, 20 aa, Artificial Sequence
  Description of Artificial Sequence: Synthetic peptide
KSGQRYYDCSMAQLGELCDL

SEQ ID NO: 283 - protein, 20 aa, Artificial Sequence
  Description of Artificial Sequence: Synthetic peptide
KPCYMAQVGELCDLPAESLS

SEQ ID NO: 284 - protein, 20 aa, Artificial Sequence
  Description of Artificial Sequence: Synthetic peptide
KACHMAQLGELCDLYQGGIN

SEQ ID NO: 285 - protein, 20 aa, Artificial Sequence
  Description of Artificial Sequence: Synthetic peptide
KTWYDCRFAQLGELCDLNMN

SEQ ID NO: 286 - protein, 20 aa, Artificial Sequence
  Description of Artificial Sequence: Synthetic peptide
KVWYPCRIAQVGELCDLDQF

SEQ ID NO: 287 - protein, 14 aa, Artificial Sequence
  Description of Artificial Sequence: Synthetic peptide
KYCGFAQLGELCVL

SEQ ID NO: 288 - protein, 14 aa, Artificial Sequence
  Description of Artificial Sequence: Synthetic peptide
LPCWIAQVGELCDL

SEQ ID NO: 289 - protein, 14 aa, Artificial Sequence
  Description of Artificial Sequence: Synthetic peptide
LPCHMAQLGELCDL

SEQ ID NO: 290 - protein, 20 aa, Artificial Sequence
  Description of Artificial Sequence: Synthetic peptide
LVGWNHYDCSVARVGELCDL

SEQ ID NO: 291 - protein, 14 aa, Artificial Sequence
  Description of Artificial Sequence: Synthetic peptide
LYCWQAQLGQLCDL

SEQ ID NO: 292 - protein, 14 aa, Artificial Sequence
  Description of Artificial Sequence: Synthetic peptide
LMCWNAQLGDLCDL

SEQ ID NO: 293 - protein, 20 aa, Artificial Sequence
  Description of Artificial Sequence: Synthetic peptide
LEYDWNQACSKAHLGELCVL

SEQ ID NO: 294 - protein, 14 aa, Artificial Sequence
  Description of Artificial Sequence: Synthetic peptide
LACRFAKLGELCDL

SEQ ID NO: 295 - protein, 14 aa, Artificial Sequence
  Description of Artificial Sequence: Synthetic peptide
LPCWMAQLGDLCDL

SEQ ID NO: 296 - protein, 20 aa, Artificial Sequence
  Description of Artificial Sequence: Synthetic peptide
LYRPNYSDCSMAQLGELCEM

SEQ ID NO: 297 - protein, 14 aa, Artificial Sequence
  Description of Artificial Sequence: Synthetic peptide
LYCWAAQLGELCDL

SEQ ID NO: 298 - protein, 14 aa, Artificial Sequence
  Description of Artificial Sequence: Synthetic peptide
LACWMAHLGDLCDL

SEQ ID NO: 299 - protein, 14 aa, Artificial Sequence
  Description of Artificial Sequence: Synthetic peptide
LPCWLAKVGDLCDL

SEQ ID NO: 300 - protein, 20 aa, Artificial Sequence
  Description of Artificial Sequence: Synthetic peptide
LPRSGWYDCSIAHVGELCDL

SEQ ID NO: 301 - protein, 20 aa, Artificial Sequence
  Description of Artificial Sequence: Synthetic peptide
LSVNKWYPCWIADVGELCDW

SEQ ID NO: 302 - protein, 14 aa, Artificial Sequence
  Description of Artificial Sequence: Synthetic peptide
LKCWMAQLGELCDL

SEQ ID NO: 303 - protein, 14 aa, Artificial Sequence
  Description of Artificial Sequence: Synthetic peptide
LDCRFAQVGDLCDI

SEQ ID NO: 304 - protein, 14 aa, Artificial Sequence
  Description of Artificial Sequence: Synthetic peptide
LWCWMAQLGELCDL

SEQ ID NO: 305 - protein, 20 aa, Artificial Sequence
  Description of Artificial Sequence: Synthetic peptide
LDETYWYDCHVAQVGELCDL

SEQ ID NO: 306 - protein, 14 aa, Artificial Sequence
  Description of Artificial Sequence: Synthetic peptide
LMCWLAQLGELCEL

SEQ ID NO: 307 - protein, 14 aa, Artificial Sequence
  Description of Artificial Sequence: Synthetic peptide
LHCHNAQVGDLCDL

SEQ ID NO: 308 - protein, 14 aa, Artificial Sequence
  Description of Artificial Sequence: Synthetic peptide
LWCHMANLGDLCDL

SEQ ID NO: 309 - protein, 20 aa, Artificial Sequence
  Description of Artificial Sequence: Synthetic peptide
LMVWDRRDCSTAQLGELCDL

SEQ ID NO: 310 - protein, 20 aa, Artificial Sequence
  Description of Artificial Sequence: Synthetic peptide
LPCWLANVGELCDLPGKFER

SEQ ID NO: 311 - protein, 20 aa, Artificial Sequence
  Description of Artificial Sequence: Synthetic peptide
LKCWMAQVGELCDLGVDDGQ

SEQ ID NO: 312 - protein, 20 aa, Artificial Sequence
  Description of Artificial Sequence: Synthetic peptide
LGCWLAHVGELCDLMFPGDE

SEQ ID NO: 313 - protein, 20 aa, Artificial Sequence
  Description of Artificial Sequence: Synthetic peptide
LPCWMAQVGQLCYLDTERHS

SEQ ID NO: 314 - protein, 20 aa, Artificial Sequence
  Description of Artificial Sequence: Synthetic peptide
LYCGFAQVGDLCDLDVEVTY

SEQ ID NO: 315 - protein, 20 aa, Artificial Sequence
  Description of Artificial Sequence: Synthetic peptide
LPCWKAYVGELCDLNMPRLD

SEQ ID NO: 316 - protein, 20 aa, Artificial Sequence
  Description of Artificial Sequence: Synthetic peptide
LDWHACWEAQVGELCDLRRS

SEQ ID NO: 317 - protein, 20 aa, Artificial Sequence
  Description of Artificial Sequence: Synthetic peptide
LWCHMANVGELCDIDWTNGS

SEQ ID NO: 318 - protein, 20 aa, Artificial Sequence
  Description of Artificial Sequence: Synthetic peptide
LACHVAQLGELCDLWPDGVN

SEQ ID NO: 319 - protein, 20 aa, Artificial Sequence
  Description of Artificial Sequence: Synthetic peptide
LHCYDAQVGELCDLENWLHQ

SEQ ID NO: 320 - protein, 20 aa, Artificial Sequence
  Description of Artificial Sequence: Synthetic peptide
LPCWLAQVGELCDLQEETGS

SEQ ID NO: 321 - protein, 20 aa, Artificial Sequence
  Description of Artificial Sequence: Synthetic peptide
LPCHLAQVGELCDLPSSMLT

SEQ ID NO: 322 - protein, 20 aa, Artificial Sequence
  Description of Artificial Sequence: Synthetic peptide
LWFYDCRFAHVGELCDLEQT

SEQ ID NO: 323 - protein, 20 aa, Artificial Sequence
  Description of Artificial Sequence: Synthetic peptide
LHILKNYPCYLAQVGELCDL

SEQ ID NO: 324 - protein, 14 aa, Artificial Sequence
  Description of Artificial Sequence: Synthetic peptide
LPCHMALLGQLCDL

SEQ ID NO: 325 - protein, 14 aa, Artificial Sequence
  Description of Artificial Sequence: Synthetic peptide
LMCWFAQLGDLCDL

SEQ ID NO: 326 - protein, 20 aa, Artificial Sequence
  Description of Artificial Sequence: Synthetic peptide
LWCWMAQVGELCDLEERSFM

SEQ ID NO: 327 - protein, 20 aa, Artificial Sequence
  Description of Artificial Sequence: Synthetic peptide
LPCWKANLGELCDLYDMGHS

SEQ ID NO: 328 - protein, 20 aa, Artificial Sequence
  Description of Artificial Sequence: Synthetic peptide
LPCWLARLGELCDLQYEYND

SEQ ID NO: 329 - protein, 20 aa, Artificial Sequence
  Description of Artificial Sequence: Synthetic peptide
LYCWMAQLGELCDLEHVDWN

SEQ ID NO: 330 - protein, 20 aa, Artificial Sequence
  Description of Artificial Sequence: Synthetic peptide
LWCGIAQLGELCDLELGIHD

SEQ ID NO: 331 - protein, 20 aa, Artificial Sequence
  Description of Artificial Sequence: Synthetic peptide
LLCWMAQLGELCDLEGEVMK

SEQ ID NO: 332 - protein, 20 aa, Artificial Sequence
  Description of Artificial Sequence: Synthetic peptide
LYCGMAHVGQLCILEDWRGA

SEQ ID NO: 333 - protein, 20 aa, Artificial Sequence
  Description of Artificial Sequence: Synthetic peptide
MENKYWYDCSVALVGELCDL

SEQ ID NO: 334 - protein, 20 aa, Artificial Sequence
  Description of Artificial Sequence: Synthetic peptide
MSWYDCWMAQVGELCDLHVL

SEQ ID NO: 335 - protein, 20 aa, Artificial Sequence
  Description of Artificial Sequence: Synthetic peptide
MGFYPCWTAQLGELCDLSVD

SEQ ID NO: 336 - protein, 20 aa, Artificial Sequence
  Description of Artificial Sequence: Synthetic peptide
NLHYDCRIAQVGELCDLTYE

SEQ ID NO: 337 - protein, 20 aa, Artificial Sequence
  Description of Artificial Sequence: Synthetic peptide
NEQMIPWPCHLAQLGDLCDL

SEQ ID NO: 338 - protein, 20 aa, Artificial Sequence
  Description of Artificial Sequence: Synthetic peptide
PSSRGYKPCWSAQVGELCEL

SEQ ID NO: 339 - protein, 20 aa, Artificial Sequence
  Description of Artificial Sequence: Synthetic peptide
PLCYSCQMARVGELCDLGCD

SEQ ID NO: 340 - protein, 20 aa, Artificial Sequence
  Description of Artificial Sequence: Synthetic peptide
PEWYDCSTAQVGELCDLFDD

SEQ ID NO: 341 - protein, 20 aa, Artificial Sequence
  Description of Artificial Sequence: Synthetic peptide
PIYQPCHMAALGELCDLGTA

SEQ ID NO: 342 - protein, 20 aa, Artificial Sequence
  Description of Artificial Sequence: Synthetic peptide
PAYYDCSIAKVGELCDLSMM

SEQ ID NO: 343 - protein, 20 aa, Artificial Sequence
  Description of Artificial Sequence: Synthetic peptide
PERGGWYDCRFAKLGELCDL

SEQ ID NO: 344 - protein, 20 aa, Artificial Sequence
  Description of Artificial Sequence: Synthetic peptide
PLNYPCWIAQLGELCDLDLR

SEQ ID NO: 345 - protein, 20 aa, Artificial Sequence
  Description of Artificial Sequence: Synthetic peptide
QVEGSYYDCRWAHLGELCDL

SEQ ID NO: 346 - protein, 14 aa, Artificial Sequence
  Description of Artificial Sequence: Synthetic peptide
QWCWMARLGELCDL

SEQ ID NO: 347 - protein, 20 aa, Artificial Sequence
  Description of Artificial Sequence: Synthetic peptide
QVHYDCSMAQLGELCDLYDE

SEQ ID NO: 348 - protein, 20 aa, Artificial Sequence
  Description of Artificial Sequence: Synthetic peptide
QFWLGCWMAQVGELCDLDQP

SEQ ID NO: 349 - protein, 20 aa, Artificial Sequence
  Description of Artificial Sequence: Synthetic peptide
RILYEYPDCWMAQLGELCEL

SEQ ID NO: 350 - protein, 20 aa, Artificial Sequence
  Description of Artificial Sequence: Synthetic peptide
RALRKFHDCSTARLGELCDL

SEQ ID NO: 351 - protein, 20 aa, Artificial Sequence
  Description of Artificial Sequence: Synthetic peptide
RSLFLWHDCSTAQLGELCDL

SEQ ID NO: 352 - protein, 20 aa, Artificial Sequence
  Description of Artificial Sequence: Synthetic peptide
RTYDPGQDCRLAQLGELCEL

SEQ ID NO: 353 - protein, 20 aa, Artificial Sequence
  Description of Artificial Sequence: Synthetic peptide
RGRWEWYDCSIAQVGELCDV

SEQ ID NO: 354 - protein, 20 aa, Artificial Sequence
  Description of Artificial Sequence: Synthetic peptide
RSFENWYDCRIAQLGELCDL

SEQ ID NO: 355 - protein, 20 aa, Artificial Sequence
  Description of Artificial Sequence: Synthetic peptide
RKTWIWKDCSIARVGELCDL

SEQ ID NO: 356 - protein, 20 aa, Artificial Sequence
  Description of Artificial Sequence: Synthetic peptide
RHFLDCRIAQIGDLCDLIGF

SEQ ID NO: 357 - protein, 20 aa, Artificial Sequence
  Description of Artificial Sequence: Synthetic peptide
RWCHMAQLGDLCELYIFDKH

SEQ ID NO: 358 - protein, 20 aa, Artificial Sequence
  Description of Artificial Sequence: Synthetic peptide
RPWRQWYDCSIARLGELCDI

SEQ ID NO: 359 - protein, 20 aa, Artificial Sequence
  Description of Artificial Sequence: Synthetic peptide
RRASWCHLAQVGELCDLLWE

SEQ ID NO: 360 - protein, 20 aa, Artificial Sequence
  Description of Artificial Sequence: Synthetic peptide
RLFDPDQNCRFALLGELCLL

SEQ ID NO: 361 - protein, 20 aa, Artificial Sequence
  Description of Artificial Sequence: Synthetic peptide
SGSNDVPHCSMADLGDLCHL

SEQ ID NO: 362 - protein, 20 aa, Artificial Sequence
  Description of Artificial Sequence: Synthetic peptide
SSYDMDQDCRWAQLGQLCAI

SEQ ID NO: 363 - protein, 20 aa, Artificial Sequence
  Description of Artificial Sequence: Synthetic peptide
SSYYSCSMAQLGELCDLKLS

SEQ ID NO: 364 - protein, 20 aa, Artificial Sequence
  Description of Artificial Sequence: Synthetic peptide
SKFYDCRIAKLGELCDLRSG

SEQ ID NO: 365 - protein, 20 aa, Artificial Sequence
  Description of Artificial Sequence: Synthetic peptide
SFVQDCSLAQLWDLCEIWTD

SEQ ID NO: 366 - protein, 20 aa, Artificial Sequence
  Description of Artificial Sequence: Synthetic peptide
SGWYPCRIARLGELCDLWEG

SEQ ID NO: 367 - protein, 20 aa, Artificial Sequence
  Description of Artificial Sequence: Synthetic peptide
SVLLSYPLCRFAQLGELCDL

SEQ ID NO: 368 - protein, 20 aa, Artificial Sequence
  Description of Artificial Sequence: Synthetic peptide
SDLMVWKPCWTAQLGELCDL

SEQ ID NO: 369 - protein, 20 aa, Artificial Sequence
  Description of Artificial Sequence: Synthetic peptide
TMASNWYDCHMAQVGELCDL

SEQ ID NO: 370 - protein, 20 aa, Artificial Sequence
  Description of Artificial Sequence: Synthetic peptide
TAAEYWYPCWMAQVGELCDL

SEQ ID NO: 371 - protein, 20 aa, Artificial Sequence
  Description of Artificial Sequence: Synthetic peptide
TSLDSYYDCGMAKVGELCDL

SEQ ID NO: 372 - protein, 20 aa, Artificial Sequence
  Description of Artificial Sequence: Synthetic peptide
TRNEFVYPCWLAQVGELCDL

SEQ ID NO: 373 - protein, 20 aa, Artificial Sequence
  Description of Artificial Sequence: Synthetic peptide
TPHYPCWMAHMGELCDLEWK

SEQ ID NO: 374 - protein, 20 aa, Artificial Sequence
  Description of Artificial Sequence: Synthetic peptide
TSFHDCRIANVGELCDLSIL

SEQ ID NO: 375 - protein, 20 aa, Artificial Sequence
  Description of Artificial Sequence: Synthetic peptide
TPCYMAKLGELCDLEEWALE

SEQ ID NO: 376 - protein, 20 aa, Artificial Sequence
  Description of Artificial Sequence: Synthetic peptide
VDVSGWKPCYMAHLGELCDL

SEQ ID NO: 377 - protein, 20 aa, Artificial Sequence
  Description of Artificial Sequence: Synthetic peptide
VETTAWYPCELAQLGELCDL

SEQ ID NO: 378 - protein, 20 aa, Artificial Sequence
  Description of Artificial Sequence: Synthetic peptide
VQYKKCWMAQLGDLCELDPS

SEQ ID NO: 379 - protein, 20 aa, Artificial Sequence
  Description of Artificial Sequence: Synthetic peptide
VRFHDCSIALVGDLCDLHMY

SEQ ID NO: 380 - protein, 20 aa, Artificial Sequence
  Description of Artificial Sequence: Synthetic peptide
VTPYYCWNAKLGELCDMMWN

SEQ ID NO: 381 - protein, 20 aa, Artificial Sequence
  Description of Artificial Sequence: Synthetic peptide
VSWYPCHMAQVGELCDLGFS

SEQ ID NO: 382 - protein, 20 aa, Artificial Sequence
  Description of Artificial Sequence: Synthetic peptide
VGRQMRKACHMALLGELCDL

SEQ ID NO: 383 - protein, 18 aa, Artificial Sequence
  Description of Artificial Sequence: Synthetic peptide
VSVWKDCSIAQLGELCDL

SEQ ID NO: 384 - protein, 20 aa, Artificial Sequence
  Description of Artificial Sequence: Synthetic peptide
VSWVDCHMAQVGELCDLRDS

SEQ ID NO: 385 - protein, 20 aa, Artificial Sequence
  Description of Artificial Sequence: Synthetic peptide
WHQWLRKDCRFAKLGELCDL

SEQ ID NO: 386 - protein, 20 aa, Artificial Sequence
  Description of Artificial Sequence: Synthetic peptide
WSSKVVKPCHIARLGELCEL

SEQ ID NO: 387 - protein, 20 aa, Artificial Sequence
  Description of Artificial Sequence: Synthetic peptide
WSWYDCRIAQIGELCDLIIM

SEQ ID NO: 388 - protein, 20 aa, Artificial Sequence
  Description of Artificial Sequence: Synthetic peptide
WLFYDCRWAQVGELCDLSGD

SEQ ID NO: 389 - protein, 20 aa, Artificial Sequence
  Description of Artificial Sequence: Synthetic peptide
WLYPECRFAQVGQLCEFRNQ

SEQ ID NO: 390 - protein, 20 aa, Artificial Sequence
  Description of Artificial Sequence: Synthetic peptide
WPWQDCSTAQLGDLCDLMSY

SEQ ID NO: 391 - protein, 20 aa, Artificial Sequence
  Description of Artificial Sequence: Synthetic peptide
WAWLDCHNAQVGELCDLLRD

SEQ ID NO: 392 - protein, 20 aa, Artificial Sequence
  Description of Artificial Sequence: Synthetic peptide
WSIANFYDCRFAHLGELCDL

SEQ ID NO: 393 - protein, 20 aa, Artificial Sequence
  Description of Artificial Sequence: Synthetic peptide
WAFYDCFTAQVGELCDLSIG

SEQ ID NO: 394 - protein, 20 aa, Artificial Sequence
  Description of Artificial Sequence: Synthetic peptide
WKFQDCRTAQVGELCDLWPY

SEQ ID NO: 395 - protein, 16 aa, Artificial Sequence
  Description of Artificial Sequence: Synthetic peptide
WYPCWMAQLGELCDLD

SEQ ID NO: 396 - protein, 14 aa, Artificial Sequence
  Description of Artificial Sequence: Synthetic peptide
YPCHMANVGELCDL

SEQ ID NO: 397 - protein, 14 aa, Artificial Sequence
  Description of Artificial Sequence: Synthetic peptide
YPCWMAQIGELCDL

SEQ ID NO: 398 - protein, 14 aa, Artificial Sequence
  Description of Artificial Sequence: Synthetic peptide
YPCHIALLGELCDL

SEQ ID NO: 399 - protein, 14 aa, Artificial Sequence
  Description of Artificial Sequence: Synthetic peptide
YDCRFAQLGELCDL

SEQ ID NO: 400 - protein, 14 aa, Artificial Sequence
  Description of Artificial Sequence: Synthetic peptide
YFCHIAKLGELCDL

SEQ ID NO: 401 - protein, 14 aa, Artificial Sequence
  Description of Artificial Sequence: Synthetic peptide
YPCRMAKLGELCDL

SEQ ID NO: 402 - protein, 14 aa, Artificial Sequence
  Description of Artificial Sequence: Synthetic peptide
YPCWLAHVGELCDL

SEQ ID NO: 403 - protein, 14 aa, Artificial Sequence
  Description of Artificial Sequence: Synthetic peptide
YPCWMAQLGELCDL

SEQ ID NO: 404 - protein, 14 aa, Artificial Sequence
  Description of Artificial Sequence: Synthetic peptide
YDCSIAQLGELCDL

SEQ ID NO: 405 - protein, 20 aa, Artificial Sequence
  Description of Artificial Sequence: Synthetic peptide
YDSRSYLPCHMAQLGDLCDL

SEQ ID NO: 406 - protein, 14 aa, Artificial Sequence
  Description of Artificial Sequence: Synthetic peptide
YPCWMALVGELCDL

SEQ ID NO: 407 - protein, 14 aa, Artificial Sequence
  Description of Artificial Sequence: Synthetic peptide
YDCRFALLGELCDL

SEQ ID NO: 408 - protein, 14 aa, Artificial Sequence
  Description of Artificial Sequence: Synthetic peptide
YWCWMAQLGELCDL

SEQ ID NO: 409 - protein, 14 aa, Artificial Sequence
  Description of Artificial Sequence: Synthetic peptide
YPCWIAQVGELCDL

SEQ ID NO: 410 - protein, 14 aa, Artificial Sequence
  Description of Artificial Sequence: Synthetic peptide
YPCWVAKLGELCDF

SEQ ID NO: 411 - protein, 14 aa, Artificial Sequence
  Description of Artificial Sequence: Synthetic peptide
YPCWIAKVGELCDL

SEQ ID NO: 412 - protein, 14 aa, Artificial Sequence
  Description of Artificial Sequence: Synthetic peptide
YWCWMAQVGELCDL

SEQ ID NO: 413 - protein, 14 aa, Artificial Sequence
  Description of Artificial Sequence: Synthetic peptide
YECHLAKLGELCDL

SEQ ID NO: 414 - protein, 14 aa, Artificial Sequence
  Description of Artificial Sequence: Synthetic peptide
YPCHIAQVGELCDL

SEQ ID NO: 415 - protein, 14 aa, Artificial Sequence
  Description of Artificial Sequence: Synthetic peptide
YPCHVAQLGELCDL

SEQ ID NO: 416 - protein, 14 aa, Artificial Sequence
  Description of Artificial Sequence: Synthetic peptide
YDCSMAQLGELCDL

SEQ ID NO: 417 - protein, 14 aa, Artificial Sequence
  Description of Artificial Sequence: Synthetic peptide
YDCRIAQVGELCDL

SEQ ID NO: 418 - protein, 20 aa, Artificial Sequence
  Description of Artificial Sequence: Synthetic peptide
YPCHMAQLGELCDLWSWGDI

SEQ ID NO: 419 - protein, 20 aa, Artificial Sequence
  Description of Artificial Sequence: Synthetic peptide
YDCRNAHVGELCDLIDVPWE

SEQ ID NO: 420 - protein, 20 aa, Artificial Sequence
  Description of Artificial Sequence: Synthetic peptide
YECWMAKLGELCDMYLEGEI

SEQ ID NO: 421 - protein, 20 aa, Artificial Sequence
  Description of Artificial Sequence: Synthetic peptide
YLCRFAQLGELCDLHVHWED

SEQ ID NO: 422 - protein, 20 aa, Artificial Sequence
  Description of Artificial Sequence: Synthetic peptide
YYCGIANVGELCDLEMGGNI

SEQ ID NO: 423 - protein, 20 aa, Artificial Sequence
  Description of Artificial Sequence: Synthetic peptide
YHCRFAQVGELCDLEPQITW

SEQ ID NO: 424 - protein, 20 aa, Artificial Sequence
  Description of Artificial Sequence: Synthetic peptide
YPCWIAQIGELCDMDPRANM

SEQ ID NO: 425 - protein, 20 aa, Artificial Sequence
  Description of Artificial Sequence: Synthetic peptide
YDCRFAQLGELCDLYETDGR

SEQ ID NO: 426 - protein, 20 aa, Artificial Sequence
  Description of Artificial Sequence: Synthetic peptide
YWCRFAQVGELCDVQMYASQ

SEQ ID NO: 427 - protein, 20 aa, Artificial Sequence
  Description of Artificial Sequence: Synthetic peptide
YACYIAKLGELCDLEMTDHG

SEQ ID NO: 428 - protein, 20 aa, Artificial Sequence
  Description of Artificial Sequence: Synthetic peptide
YACWLAKVGELCDMDEDFTI

SEQ ID NO: 429 - protein, 20 aa, Artificial Sequence
  Description of Artificial Sequence: Synthetic peptide
YSCGIAKVGELCDLVDQEPD

SEQ ID NO: 430 - protein, 20 aa, Artificial Sequence
  Description of Artificial Sequence: Synthetic peptide
YDCSIAQLGELCDVEPWESM

SEQ ID NO: 431 - protein, 20 aa, Artificial Sequence
  Description of Artificial Sequence: Synthetic peptide
YWCRWAQVGELCDLEVENKD

SEQ ID NO: 432 - protein, 20 aa, Artificial Sequence
  Description of Artificial Sequence: Synthetic peptide
YDCRMAKVGELCDLWWDTLY

SEQ ID NO: 433 - protein, 20 aa, Artificial Sequence
  Description of Artificial Sequence: Synthetic peptide
YDCHMAKLGELCDLMLGDVT

SEQ ID NO: 434 - protein, 20 aa, Artificial Sequence
  Description of Artificial Sequence: Synthetic peptide
YPCHLAHVGELCDLEGGTEF

SEQ ID NO: 435 - protein, 20 aa, Artificial Sequence
  Description of Artificial Sequence: Synthetic peptide
YDCSIARVGELCDLLQDWWP

SEQ ID NO: 436 - protein, 20 aa, Artificial Sequence
  Description of Artificial Sequence: Synthetic peptide
YHCFLAQVGDLCDLWDSMTT

SEQ ID NO: 437 - protein, 20 aa, Artificial Sequence
  Description of Artificial Sequence: Synthetic peptide
YDCFFAHVGELCDLMGNSGT

SEQ ID NO: 438 - protein, 20 aa, Artificial Sequence
  Description of Artificial Sequence: Synthetic peptide
YPCWLALPGELCDLMESTVN

SEQ ID NO: 439 - protein, 20 aa, Artificial Sequence
  Description of Artificial Sequence: Synthetic peptide
YDCSLAQLGELCDLTGPSYG

SEQ ID NO: 440 - protein, 20 aa, Artificial Sequence
  Description of Artificial Sequence: Synthetic peptide
YPCHVAQVGELCDLSPGLHG

SEQ ID NO: 441 - protein, 14 aa, Artificial Sequence
  Description of Artificial Sequence: Synthetic peptide
YFCWMAKLGELCDL

SEQ ID NO: 442 - protein, 14 aa, Artificial Sequence
  Description of Artificial Sequence: Synthetic peptide
YFCWMAQLGELCDL

SEQ ID NO: 443 - protein, 14 aa, Artificial Sequence
  Description of Artificial Sequence: Synthetic peptide
YPCHLALLGELCDL

SEQ ID NO: 444 - protein, 14 aa, Artificial Sequence
  Description of Artificial Sequence: Synthetic peptide
YPCWMAQVGELCDL

SEQ ID NO: 445 - protein, 14 aa, Artificial Sequence
  Description of Artificial Sequence: Synthetic peptide
YDCSIAKLGELCDL

SEQ ID NO: 446 - protein, 14 aa, Artificial Sequence
  Description of Artificial Sequence: Synthetic peptide
YWCHIAQLGELCDL

SEQ ID NO: 447 - protein, 14 aa, Artificial Sequence
  Description of Artificial Sequence: Synthetic peptide
YPCWIAKLGELCDF

SEQ ID NO: 448 - protein, 20 aa, Artificial Sequence
  Description of Artificial Sequence: Synthetic peptide
YPCWLARVGELCDLDSGDVH

SEQ ID NO: 449 - protein, 20 aa, Artificial Sequence
  Description of Artificial Sequence: Synthetic peptide
YDCSMALLGELCDLWMPAIK

SEQ ID NO: 450 - protein, 20 aa, Artificial Sequence
  Description of Artificial Sequence: Synthetic peptide
YPCWMAHVGELCDLEGWFGV

SEQ ID NO: 451 - protein, 20 aa, Artificial Sequence
  Description of Artificial Sequence: Synthetic peptide
YKFLPCWRARVGELCDLDTA

SEQ ID NO: 452 - protein, 20 aa, Artificial Sequence
  Description of Artificial Sequence: Synthetic peptide
YPCHMAQLGELCDLWSWGDI

SEQ ID NO: 453 - protein, 20 aa, Artificial Sequence
  Description of Artificial Sequence: Synthetic peptide
YPCRIAKLGELCDLSEWQQL

SEQ ID NO: 454 - protein, 20 aa, Artificial Sequence
  Description of Artificial Sequence: Synthetic peptide
YACWFAQVGELCDLEEDMVT

SEQ ID NO: 455 - protein, 20 aa, Artificial Sequence
  Description of Artificial Sequence: Synthetic peptide
YPCWFAKLGELCDLGLTDTK

SEQ ID NO: 456 - protein, 20 aa, Artificial Sequence
  Description of Artificial Sequence: Synthetic peptide
YTWLDCSVAQLGQLCDLWSM

SEQ ID NO: 457 - protein, 20 aa, Artificial Sequence
  Description of Artificial Sequence: Synthetic peptide
YPCWMAQVGELCDLFLESVP

SEQ ID NO: 458 - protein, 17 aa, Artificial Sequence
  Description of Artificial Sequence: Synthetic peptide
  MOD_RES (1)..(1): Any amino acid
  MOD_RES (2)..(2): Any amino acid comprising an aromatic side chain
  MOD_RES (3)..(3): Any amino acid comprising a large hydrophobic side chain or an aromatic side chain
  MOD_RES (6)..(6): Any amino acid comprising an aromatic side chain
  MOD_RES (7)..(7): Any amino acid comprising a large hydrophobic side chain
  MOD_RES (9)..(9): Any amino acid comprising a basic side chain or a polar/neutral side chain
  MOD_RES (10)..(10): Any amino acid comprising a large hydrophobic side chain
  MOD_RES (12)..(12): Any amino acid comprising an acidic side chain or a polar/neutral side chain
  MOD_RES (16)..(16): Any amino acid comprising a large hydrophobic side chain
  MOD_RES (17)..(17): Any amino acid comprising an acidic side chain
XXXPCXXAXXGXLCDXX

SEQ ID NO: 459 - protein, 16 aa, Artificial Sequence
  Description of Artificial Sequence: Synthetic peptide
  MOD_RES (1)..(1): Any amino acid comprising an aromatic side chain
  MOD_RES (2)..(2): Any amino acid comprising a large hydrophobic side chain or an aromatic side chain
  MOD_RES (5)..(5): Any amino acid comprising an aromatic side chain
  MOD_RES (6)..(6): Any amino acid comprising a large hydrophobic side chain
  MOD_RES (8)..(8): Any amino acid comprising a basic side chain or a polar/neutral side chain
  MOD_RES (9)..(9): Any amino acid comprising a large hydrophobic side chain
  MOD_RES (11)..(11): Any amino acid comprising an acidic side chain or a polar/neutral side chain
  MOD_RES (15)..(15): Any amino acid comprising a large hydrophobic side chain
  MOD_RES (16)..(16): Any amino acid comprising an acidic side chain
XXPCXXAXXGXLCDXX

SEQ ID NO: 460 - protein, 14 aa, Artificial Sequence
  Description of Artificial Sequence: Synthetic peptide
  MOD_RES (1)..(1): Any amino acid comprising a large hydrophobic side chain or an aromatic side chain
  MOD_RES (4)..(4): Any amino acid comprising an aromatic side chain
  MOD_RES (5)..(5): Any amino acid comprising a large hydrophobic side chain
  MOD_RES (7)..(7): Any amino acid comprising a basic side chain or a polar/neutral side chain
  MOD_RES (8)..(8): Any amino acid comprising a large hydrophobic side chain
  MOD_RES (10)..(10): Any amino acid comprising an acidic side chain or a polar/neutral side chain
  MOD_RES (14)..(14): Any amino acid comprising a large hydrophobic side chain
XPCXXAXXGXLCDX

SEQ ID NO: 461 - protein, 12 aa, Artificial Sequence
  Description of Artificial Sequence: Synthetic peptide
  MOD_RES (3)..(3): Any amino acid comprising an aromatic side chain
  MOD_RES (4)..(4): Any amino acid comprising a large hydrophobic side chain
  MOD_RES (6)..(6): Any amino acid comprising a basic side chain or a polar/neutral side chain
  MOD_RES (7)..(7): Any amino acid comprising a large hydrophobic side chain
  MOD_RES (9)..(9): Any amino acid comprising an acidic side chain or a polar/neutral side chain
PCXXAXXGXLCD

SEQ ID NO: 462 - protein, 10 aa, Artificial Sequence
  Description of Artificial Sequence: Synthetic peptide
  MOD_RES (2)..(2): Any amino acid comprising an aromatic side chain
  MOD_RES (3)..(3): Any amino acid comprising a large hydrophobic side chain
  MOD_RES (5)..(5): Any amino acid comprising a basic side chain or a polar/neutral side chain
  MOD_RES (6)..(6): Any amino acid comprising a large hydrophobic side chain
  MOD_RES (8)..(8): Any amino acid comprising an acidic side chain or a polar/neutral side chain
CXXAXXGXLC

SEQ ID NO: 463 - protein, 8 aa, Artificial Sequence
  Description of Artificial Sequence: Synthetic peptide
  MOD_RES (1)..(1): Any amino acid comprising an aromatic side chain
  MOD_RES (2)..(2): Any amino acid comprising a large hydrophobic side chain
  MOD_RES (4)..(4): Any amino acid comprising a basic side chain or a polar/neutral side chain
  MOD_RES (5)..(5): Any amino acid comprising a large hydrophobic side chain
  MOD_RES (7)..(7): Any amino acid comprising an acidic side chain or a polar/neutral side chain
XXAXXGXL

SEQ ID NO: 464 - protein, 22 aa, Artificial Sequence
  Description of Artificial Sequence: Synthetic peptide
AGDWLPCWMAELGELCDLEGPT

SEQ ID NO: 465 - protein, 22 aa, Artificial Sequence
  Description of Artificial Sequence: Synthetic peptide
AQVRREWYPCWMAQLGELCDLT

SEQ ID NO: 466 - protein, 22 aa, Artificial Sequence
  Description of Artificial Sequence: Synthetic peptide
AKGWDTWKPCWLANLGELCDLE

SEQ ID NO: 467 - protein, 22 aa, Artificial Sequence
  Description of Artificial Sequence: Synthetic peptide
DIGYYPCWMAQVGDLCDLDDEK

SEQ ID NO: 468 - protein, 22 aa, Artificial Sequence
  Description of Artificial Sequence: Synthetic peptide
DSDWWPCWMAQLGELCDLEDAR

SEQ ID NO: 469 - protein, 22 aa, Artificial Sequence
  Description of Artificial Sequence: Synthetic peptide
DVLGDRWYPCWIAKLGELCDLD

SEQ ID NO: 470 - protein, 22 aa, Artificial Sequence
  Description of Artificial Sequence: Synthetic peptide
EGVFFPCWIARLGELCDLDHGL

SEQ ID NO: 471 - protein, 22 aa, Artificial Sequence
  Description of Artificial Sequence: Synthetic peptide
ETEQMSWYPCWVAQLWELCDLD

SEQ ID NO: 472 - protein, 22 aa, Artificial Sequence
  Description of Artificial Sequence: Synthetic peptide
ERRPDTWFPCWRALVGELCDLE

SEQ ID NO: 473 - protein, 22 aa, Artificial Sequence
  Description of Artificial Sequence: Synthetic peptide
FYPCWMAHLGELCDLDGDTDSM

SEQ ID NO: 474 - protein, 22 aa, Artificial Sequence
  Description of Artificial Sequence: Synthetic peptide
FYPCWMANLGELCDLDFLRELN

SEQ ID NO: 475 - protein, 22 aa, Artificial Sequence
  Description of Artificial Sequence: Synthetic peptide
FYPCWTALLGELCDLEPGPPAM

SEQ ID NO: 476 - protein, 22 aa, Artificial Sequence
  Description of Artificial Sequence: Synthetic peptide
GERWKPCWIAQLGELCDLDFNW

SEQ ID NO: 477 - protein, 22 aa, Artificial Sequence
  Description of Artificial Sequence: Synthetic peptide
GRQQKGWYPCWLAQLGELCDME

SEQ ID NO: 478 - protein, 22 aa, Artificial Sequence
  Description of Artificial Sequence: Synthetic peptide
GEAWYPCWLARLGELCDMDPRV

SEQ ID NO: 479 - protein, 22 aa, Artificial Sequence
  Description of Artificial Sequence: Synthetic peptide
GTTWYPCWLAQLGELCDLDVLE

SEQ ID NO: 480 - protein, 22 aa, Artificial Sequence
  Description of Artificial Sequence: Synthetic peptide
GPRFYPCWIAQLGELCDLEDMG

SEQ ID NO: 481 - protein, 22 aa, Artificial Sequence
  Description of Artificial Sequence: Synthetic peptide
HASWLPCWLAQLGELCDLEPNP

SEQ ID NO: 482 - protein, 22 aa, Artificial Sequence
  Description of Artificial Sequence: Synthetic peptide
IRSCSPCWSADVGELCDLECEW

SEQ ID NO: 483 - protein, 22 aa, Artificial Sequence
  Description of Artificial Sequence: Synthetic peptide
IGSWWPCWMAQLGELCDLEPEL

SEQ ID NO: 484 - protein, 22 aa, Artificial Sequence
  Description of Artificial Sequence: Synthetic peptide
KSNFFPCWIAQLGQLCDLEPET

SEQ ID NO: 485 - protein, 22 aa, Artificial Sequence
  Description of Artificial Sequence: Synthetic peptide
KMHKAVWLPCWMAQVGELCDLE

SEQ ID NO: 486 - protein, 22 aa, Artificial Sequence
  Description of Artificial Sequence: Synthetic peptide
KLQSWRWYPCWMAQLGELCDLD

SEQ ID NO: 487 - protein, 22 aa, Artificial Sequence
  Description of Artificial Sequence: Synthetic peptide
KSGWYPCWMAKLGELCDLEAQP

SEQ ID NO: 488 - protein, 22 aa, Artificial Sequence
  Description of Artificial Sequence: Synthetic peptide
NRRWYPCWMAQLGELCDLDSRP

SEQ ID NO: 489 - protein, 22 aa, Artificial Sequence
  Description of Artificial Sequence: Synthetic peptide
NGAWYPCWMAQVGELCDLEERW

SEQ ID NO: 490 - protein, 22 aa, Artificial Sequence
  Description of Artificial Sequence: Synthetic peptide
NNSREGWFPCWLAKLGDLCDLD

SEQ ID NO: 491 - protein, 22 aa, Artificial Sequence
  Description of Artificial Sequence: Synthetic peptide
NEPEGGFYPCWLAQLGELCDLH

SEQ ID NO: 492 - protein, 20 aa, Artificial Sequence
  Description of Artificial Sequence: Synthetic peptide
QPCWLAQVGDLCDLLWPGPL

SEQ ID NO: 493 - protein, 22 aa, Artificial Sequence
  Description of Artificial Sequence: Synthetic peptide
QDEAVEWFPCWMARLGELCDLE

SEQ ID NO: 494 - protein, 22 aa, Artificial Sequence
  Description of Artificial Sequence: Synthetic peptide
QTKLEGWYPCWMAQLGELCDLD

SEQ ID NO: 495 - protein, 22 aa, Artificial Sequence
  Description of Artificial Sequence: Synthetic peptide
QDRRSPWYPCWMAKLGELCDLA

SEQ ID NO: 496 - protein, 22 aa, Artificial Sequence
  Description of Artificial Sequence: Synthetic peptide
QDGWLPCWMAQLGELCDLEYKR

SEQ ID NO: 497 - protein, 22 aa, Artificial Sequence
  Description of Artificial Sequence: Synthetic peptide
QGPVRLWYPCWMAQLGELCDLD

SEQ ID NO: 498 - protein, 22 aa, Artificial Sequence
  Description of Artificial Sequence: Synthetic peptide
RKHFYPCWMAQLGELCDLEGMP

SEQ ID NO: 499 - protein, 22 aa, Artificial Sequence
  Description of Artificial Sequence: Synthetic peptide
RQAWYPCWMAQLGELCDLEAEL

SEQ ID NO: 500 - protein, 22 aa, Artificial Sequence
  Description of Artificial Sequence: Synthetic peptide
RQRWYPCWMARLGELCDLDEPT

SEQ ID NO: 501 - protein, 22 aa, Artificial Sequence
  Description of Artificial Sequence: Synthetic peptide
RDESAGYYPCWIAQLGELCDLE

SEQ ID NO: 502 - protein, 22 aa, Artificial Sequence
  Description of Artificial Sequence: Synthetic peptide
RGMCYPCWFARLGELCDLECDQ

SEQ ID NO: 503 - protein, 22 aa, Artificial Sequence
  Description of Artificial Sequence: Synthetic peptide
RVTWYPCWMAQLGELCDLEESV

SEQ ID NO: 504 - protein, 22 aa, Artificial Sequence
  Description of Artificial Sequence: Synthetic peptide
RDQYYPCWMAQLGELCDLDEVF

SEQ ID NO: 505 - protein, 22 aa, Artificial Sequence
  Description of Artificial Sequence: Synthetic peptide
SVVVNNWLPCWMAQLGELCDLD

SEQ ID NO: 506 - protein, 22 aa, Artificial Sequence
  Description of Artificial Sequence: Synthetic peptide
SGHWYPCWMARLGELCDMEERA

SEQ ID NO: 507 - protein, 24 aa, Artificial Sequence
  Description of Artificial Sequence: Synthetic peptide
SEQWWPCWIARLGELCDLDRELSE

SEQ ID NO: 508 - protein, 22 aa, Artificial Sequence
  Description of Artificial Sequence: Synthetic peptide
SWHAETWYPCWLAQVGELCDLD

SEQ ID NO: 509 - protein, 21 aa, Artificial Sequence
  Description of Artificial Sequence: Synthetic peptide
SGHCYPCWLAGLGELCDLNCG

SEQ ID NO: 510 - protein, 22 aa, Artificial Sequence
  Description of Artificial Sequence: Synthetic peptide
TGRWKPCWMAGLHELCDLEGFR

SEQ ID NO: 511 - protein, 24 aa, Artificial Sequence
  Description of Artificial Sequence: Synthetic peptide
TRRWYPCYLAKLGELCDLFEGGTR

SEQ ID NO: 512 - protein, 22 aa, Artificial Sequence
  Description of Artificial Sequence: Synthetic peptide
VMSPTRWLPCWIAKLGELCDLE

SEQ ID NO: 513 - protein, 22 aa, Artificial Sequence
  Description of Artificial Sequence: Synthetic peptide
VPRANAWHPCWMAQLGELCDLE

SEQ ID NO: 514 - protein, 22 aa, Artificial Sequence
  Description of Artificial Sequence: Synthetic peptide
VRPMGVWYPCWIAQLGELCDLV

SEQ ID NO: 515 - protein, 22 aa, Artificial Sequence
  Description of Artificial Sequence: Synthetic peptide
VPRWYPCWIAQLGELCDLDSDD

SEQ ID NO: 516 - protein, 16 aa, Artificial Sequence
  Description of Artificial Sequence: Synthetic peptide
WLPCWIARLGDLCDLE

SEQ ID NO: 517 - protein, 16 aa, Artificial Sequence
  Description of Artificial Sequence: Synthetic peptide
WYPCWMALLGELCDQE

SEQ ID NO: 518 - protein, 16 aa, Artificial Sequence
  Description of Artificial Sequence: Synthetic peptide
WYPCYRARLGELCDLD

SEQ ID NO: 519 - protein, 22 aa, Artificial Sequence
  Description of Artificial Sequence: Synthetic peptide
WQREWRWFPCWMAKLGDMCDLD

SEQ ID NO: 520 - protein, 16 aa, Artificial Sequence
  Description of Artificial Sequence: Synthetic peptide
WYPCWLAQLGDLCDLD

SEQ ID NO: 521 - protein, 16 aa, Artificial Sequence
  Description of Artificial Sequence: Synthetic peptide
WFPCWMAQLGQLCDLE

SEQ ID NO: 522 - protein, 22 aa, Artificial Sequence
  Description of Artificial Sequence: Synthetic peptide
WRPCWRAYLGELCDLEAMPRAT

SEQ ID NO: 523 - protein, 22 aa, Artificial Sequence
  Description of Artificial Sequence: Synthetic peptide
WYPCWMAQLGELCDLQTMGYSH

SEQ ID NO: 524 - protein, 22 aa, Artificial Sequence
  Description of Artificial Sequence: Synthetic peptide
WLPCWIASLGELCDLDTGKRQG

SEQ ID NO: 525 - protein, 22 aa, Artificial Sequence
  Description of Artificial Sequence: Synthetic peptide
WLPCWMAHLGQLCDLDLPGKSM

SEQ ID NO: 526 - protein, 22 aa, Artificial Sequence
  Description of Artificial Sequence: Synthetic peptide
WWPCWMAQLGEMCDLEYPYVPG

SEQ ID NO: 527 - protein, 22 aa, Artificial Sequence
  Description of Artificial Sequence: Synthetic peptide
WGRKEQWLPCWKAQLGELCDLE

SEQ ID NO: 528 - protein, 22 aa, Artificial Sequence
  Description of Artificial Sequence: Synthetic peptide
WLNRHLFNPCWMARLGELCDLE

SEQ ID NO: 529 - protein, 21 aa, Artificial Sequence
  Description of Artificial Sequence: Synthetic peptide
WLPCWLAKLGELCDLEWLPCW

SEQ ID NO: 530 - protein, 22 aa, Artificial Sequence
  Description of Artificial Sequence: Synthetic peptide
WGRNRSWYPCWMAQLGELCDLE

SEQ ID NO: 531 - protein, 25 aa, Artificial Sequence
  Description of Artificial Sequence: Synthetic peptide
WYPCWVAQLGEICDLEMTGPDSWYP

SEQ ID NO: 532 - protein, 22 aa, Artificial Sequence
  Description of Artificial Sequence: Synthetic peptide
WRRWYPCWVAQVGELCDLEIEA

SEQ ID NO: 533 - protein, 16 aa, Artificial Sequence
  Description of Artificial Sequence: Synthetic peptide
WYPCWLAQLGELCDLD

SEQ ID NO: 534 - skipped

SEQ ID NO: 535 - protein, 16 aa, Artificial Sequence
  Description of Artificial Sequence: Synthetic peptide
WYPCWMARLGELCDLE

SEQ ID NO: 536 - protein, 22 aa, Artificial Sequence
  Description of Artificial Sequence: Synthetic peptide
WGTTWRWYPCWMAQLGELCDLE

SEQ ID NO: 537 - protein, 16 aa, Artificial Sequence
  Description of Artificial Sequence: Synthetic peptide
WYPCWIAKLGELCDLE

SEQ ID NO: 538 - protein, 16 aa, Artificial Sequence
  Description of Artificial Sequence: Synthetic peptide
WYPCWIAQLGELCDLD

SEQ ID NO: 539 - protein, 16 aa, Artificial Sequence
  Description of Artificial Sequence: Synthetic peptide
WYPCWLAKLGELCDLD

SEQ ID NO: 540 - protein, 16 aa, Artificial Sequence
  Description of Artificial Sequence: Synthetic peptide
WYPCWMAQPGELCDVD

SEQ ID NO: 541 - protein, 16 aa, Artificial Sequence
  Description of Artificial Sequence: Synthetic peptide
WHPCWIAQLGELCDLE

SEQ ID NO: 542 - protein, 16 aa, Artificial Sequence
  Description of Artificial Sequence: Synthetic peptide
WYPCWIAQLGELCDLE

SEQ ID NO: 543 - protein, 22 aa, Artificial Sequence
  Description of Artificial Sequence: Synthetic peptide
WYPCWMAQLGELCDLDESTRLT

SEQ ID NO: 544 - protein, 22 aa, Artificial Sequence
  Description of Artificial Sequence: Synthetic peptide
WWPCWMAQLGDLCDLEETSGGT

SEQ ID NO: 545 - protein, 22 aa, Artificial Sequence
  Description of Artificial Sequence: Synthetic peptide
WYPCWMAQLGELCDLGPTESNL

SEQ ID NO: 546 - protein, 22 aa, Artificial Sequence
  Description of Artificial Sequence: Synthetic peptide
WYPCWMANLGELCDLEYPSWAQ

SEQ ID NO: 547 - protein, 22 aa, Artificial Sequence
  Description of Artificial Sequence: Synthetic peptide
WYPCWMAQLGELCDLDAGARHL

SEQ ID NO: 548 - protein, 22 aa, Artificial Sequence
  Description of Artificial Sequence: Synthetic peptide
WLPCWMAQLGDLCDLEQYVPLP

SEQ ID NO: 549 - protein, 22 aa, Artificial Sequence
  Description of Artificial Sequence: Synthetic peptide
WYPCWMAQLGELCDLDDHWPAM

SEQ ID NO: 550 - protein, 22 aa, Artificial Sequence
  Description of Artificial Sequence: Synthetic peptide
WYPCWRAQLGELCDLDPPIAVE

SEQ ID NO: 551 - protein, 22 aa, Artificial Sequence
  Description of Artificial Sequence: Synthetic peptide
WYPCWMANLGELCDLEAERSPV

SEQ ID NO: 552 - protein, 22 aa, Artificial Sequence
  Description of Artificial Sequence: Synthetic peptide
WYPCWMAQLGDLCDLEKPVTER

SEQ ID NO: 553 - protein, 22 aa, Artificial Sequence
  Description of Artificial Sequence: Synthetic peptide
WYPCWIARLGELCDLETSGGFP

SEQ ID NO: 554 - protein, 16 aa, Artificial Sequence
  Description of Artificial Sequence: Synthetic peptide
YYPCWMARLGELCDLD

SEQ ID NO: 555 - protein, 16 aa, Artificial Sequence
  Description of Artificial Sequence: Synthetic peptide
YYPCWMAQLGELCDLE

SEQ ID NO: 556 - protein, 22 aa, Artificial Sequence
  Description of Artificial Sequence: Synthetic peptide
YRGWLPCWRAKLGDLCDLGQPM

SEQ ID NO: 557 - protein, 22 aa, Artificial Sequence
  Description of Artificial Sequence: Synthetic peptide
YLPCWMAHLGELCDLDSPLKAR

SEQ ID NO: 558 - protein, 18 aa, Artificial Sequence
  Description of Artificial Sequence: Synthetic peptide
GGYDCRIAQVGELCDLGG

SEQ ID NO: 559 - protein, 24 aa, Artificial Sequence
  Description of Artificial Sequence: Synthetic peptide
GGVQYKKCWMAQLGDLCELDPSGG

SEQ ID NO: 560 - protein, 26 aa, Artificial Sequence
  Description of Artificial Sequence: Synthetic peptide
GGWGTTWRWYPCWMAQLGELCDLEGG

SEQ ID NO: 561 - protein, 24 aa, Artificial Sequence
  Description of Artificial Sequence: Synthetic peptide
GGYPCHMAQLGELCDLWSWGDIGG

SEQ ID NO: 562 - protein, 26 aa, Artificial Sequence
  Description of Artificial Sequence: Synthetic peptide
GGFYPCWTALLGELCDLEPGPPAMGG

SEQ ID NO: 563 - protein, 26 aa, Artificial Sequence
  Description of Artificial Sequence: Synthetic peptide
GGWRRWYPCWVAQVGELCDLEIEAGG

SEQ ID NO: 564 - protein, 26 aa, Artificial Sequence
  Description of Artificial Sequence: Synthetic peptide
GGRQRWYPCWMARLGELCDLDEPTGG

SEQ ID NO: 565 - protein, 26 aa, Artificial Sequence
  Description of Artificial Sequence: Synthetic peptide
GGWYPCWMAQLGDLCDLEKPVTERGG

SEQ ID NO: 566 - protein, 26 aa, Artificial Sequence
  Description of Artificial Sequence: Synthetic peptide
GGDVLGDRWYPCWIAKLGELCDLDGG

SEQ ID NO: 567 - protein, 20 aa, Artificial Sequence
  Description of Artificial Sequence: Synthetic peptide
GGWYPCWIAQLGELCDLDGG

SEQ ID NO: 568 - protein, 20 aa, Artificial Sequence
  Description of Artificial Sequence: Synthetic peptide
GGWYPCWLAKLGELCDLDGG

SEQ ID NO: 569 - protein, 24 aa, Artificial Sequence
  Description of Artificial Sequence: Synthetic peptide
FYPCWTALLGELCDLEPGPPAMGG

SEQ ID NO: 570 - protein, 24 aa, Artificial Sequence
  Description of Artificial Sequence: Synthetic peptide
WRRWYPCWVAQVGELCDLEIEAGG

SEQ ID NO: 571 - protein, 24 aa, Artificial Sequence
  Description of Artificial Sequence: Synthetic peptide
RQRWYPCWMARLGELCDLDEPTGG

SEQ ID NO: 572 - protein, 24 aa, Artificial Sequence
  Description of Artificial Sequence: Synthetic peptide
WYPCWMAQLGDLCDLEKPVTERGG

SEQ ID NO: 573-574 - skipped (2 entries)

SEQ ID NO: 575 - protein, 16 aa, Artificial Sequence
  Description of Artificial Sequence: Synthetic peptide
  MOD_RES (1)..(1): E, F, G, I, L, R, S, W, or Y
  MOD_RES (2)..(2): F,  H, K, L, N, Q, S, T, V, W, or Y
  MOD_RES (3)..(3): E, G, L, P, or S
  MOD_RES (5)..(5): E, F, G, H, Q, R, S, W, or Y
  MOD_RES (6)..(6): E, I, K, L, M, N, R, S, T, or V
  MOD_RES (7)..(7): A, D, G, or Y
  MOD_RES (8)..(8): A, C, D, E, G, H, K, L, N, Q, R, S, or T
  MOD_RES (9)..(9): D, F, L, M, P, R, or V
  MOD_RES (10)..(10): G, R W, or Y
  MOD_RES (11)..(11): A, D, E, Q, W, or Y
  MOD_RES (12)..(12): I, L, Q, V, or Y
  MOD_RES (14)..(14): D, E, G, H, V, or Y
  MOD_RES (15)..(15): D, F, H, I, K, L, M, or V
  MOD_RES (16)..(16): A, D, E, G, H, K, L, N, Q, V, or W
XXXCXXXXXXXXCXXX

SEQ ID NO: 576 - protein, 14 aa, Artificial Sequence
  Description of Artificial Sequence: Synthetic peptide
  MOD_RES (1)..(1): F, H, K, L, N, Q, S, T, V, W, or Y
  MOD_RES (2)..(2): E, G, L, P, or S
  MOD_RES (4)..(4): E, F, G, H, Q, R, S, W, or Y
  MOD_RES (5)..(5): E, I, K, L, M, N, R, S, T, or V
  MOD_RES (6)..(6): A, D, G, or Y
  MOD_RES (7)..(7): A, C, D, E, G, H, K, L, N, Q, R, S, or T
  MOD_RES (8)..(8): D, F, L, M, P, R, or V
  MOD_RES (9)..(9): G, R W, or Y
  MOD_RES (10)..(10): A, D, E, Q, W, or Y
  MOD_RES (11)..(11): I, L, Q, V, or Y
  MOD_RES (13)..(13): D, E, G, H, V, or Y
  MOD_RES (14)..(14): D, F, H, I, K, L, M, or V
XXCXXXXXXXXCXX

SEQ ID NO: 577 - protein, 12 aa, Artificial Sequence
  Description of Artificial Sequence: Synthetic peptide
  MOD_RES (1)..(1): E, G, L, P, or S
  MOD_RES (3)..(3): E, F, G, H, Q, R, S, W, or Y
  MOD_RES (4)..(4): E, I, K, L, M, N, R, S, T, or V
  MOD_RES (5)..(5): A, D, G, or Y
  MOD_RES (6)..(6): A, C, D, E, G, H, K, L, N, Q, R, S, or T
  MOD_RES (7)..(7): D, F, L, M, P, R, or V
  MOD_RES (8)..(8): G, R W, or Y
  MOD_RES (9)..(9): A, D, E, Q, W, or Y
  MOD_RES (10)..(10): I, L, Q, V, or Y
  MOD_RES (12)..(12): D, E, G, H, V, or Y
XCXXXXXXXXCX

SEQ ID NO: 578 - protein, 10 aa, Artificial Sequence
  Description of Artificial Sequence: Synthetic peptide
  MOD_RES (2)..(2): E, F, G, H, Q, R, S, W, or Y
  MOD_RES (3)..(3): E, I, K, L, M, N, R, S, T, or V
  MOD_RES (4)..(4): A, D, G, or Y
  MOD_RES (5)..(5): A, C, D, E, G, H, K, L, N, Q, R, S, or T
  MOD_RES (6)..(6): D, F, L, M, P, R, or V
  MOD_RES (7)..(7): G, R, W, or Y
  MOD_RES (8)..(8): A, D, E, Q, W, or Y
  MOD_RES (9)..(9): I, L, Q, V, or Y
CXXXXXXXXC

SEQ ID NO: 579 - protein, 8 aa, Artificial Sequence
  Description of Artificial Sequence: Synthetic peptide
  MOD_RES (1)..(1): E, F, G, H, Q, R, S, W, or Y
  MOD_RES (2)..(2): E, I, K, L, M, N, R, S, T, or V
  MOD_RES (3)..(3): A, D, G, or Y
  MOD_RES (4)..(4): A, C, D, E, G, H, K, L, N, Q, R, S, or T
  MOD_RES (5)..(5): D, F, L, M, P, R, or V
  MOD_RES (6)..(6): G, R, W, or Y
  MOD_RES (7)..(7): A, D, E, Q, W, or Y
  MOD_RES (8)..(8): I, L, Q, V, or Y
XXXXXXXX

SEQ ID NO: 580 - protein, 21 aa, Artificial Sequence
  Description of Artificial Sequence: Synthetic peptide
VRAWYPCWIARLGELCDLEVD

SEQ ID NO: 581 - protein, 16 aa, Artificial Sequence
  Description of Artificial Sequence: Synthetic peptide
WFPCWMAQLGEVCDLD

SEQ ID NO: 582 - protein, 16 aa, Artificial Sequence
  Description of Artificial Sequence: Synthetic peptide
WYPCHMAKLRELCDLD

SEQ ID NO: 583 - protein, 16 aa, Artificial Sequence
  Description of Artificial Sequence: Synthetic peptide
SLPCWMAQLGDLCELH

SEQ ID NO: 584 - protein, 16 aa, Artificial Sequence
  Description of Artificial Sequence: Synthetic peptide
SNPCWMAQLWELCDLE

SEQ ID NO: 585 - protein, 16 aa, Artificial Sequence
  Description of Artificial Sequence: Synthetic peptide
YKPCWIAQLGELCELE

SEQ ID NO: 586 - protein, 16 aa, Artificial Sequence
  Description of Artificial Sequence: Synthetic peptide
WQPCWMAQLGELCDLE

SEQ ID NO: 587 - protein, 16 aa, Artificial Sequence
  Description of Artificial Sequence: Synthetic peptide
WKPCWLAQLGDLCEME

SEQ ID NO: 588 - protein, 16 aa, Artificial Sequence
  Description of Artificial Sequence: Synthetic peptide
WLPCWMAKLGDLCELE

SEQ ID NO: 589 - protein, 16 aa, Artificial Sequence
  Description of Artificial Sequence: Synthetic peptide
WLPCWMAQLGELCVME

SEQ ID NO: 590 - protein, 16 aa, Artificial Sequence
  Description of Artificial Sequence: Synthetic peptide
LHPCWMAQLGELCDLE

SEQ ID NO: 591 - protein, 16 aa, Artificial Sequence
  Description of Artificial Sequence: Synthetic peptide
SLPCWMAQLGELCDLV

SEQ ID NO: 592 - protein, 16 aa, Artificial Sequence
  Description of Artificial Sequence: Synthetic peptide
WKPCWMAGLGELCELD

SEQ ID NO: 593 - protein, 16 aa, Artificial Sequence
  Description of Artificial Sequence: Synthetic peptide
WWPCSSAELGEICDFD

SEQ ID NO: 594 - protein, 16 aa, Artificial Sequence
  Description of Artificial Sequence: Synthetic peptide
WQPCWRAKLGELCDLE

SEQ ID NO: 595 - protein, 16 aa, Artificial Sequence
  Description of Artificial Sequence: Synthetic peptide
WSPCWIATLGELCDLD

SEQ ID NO: 596 - protein, 16 aa, Artificial Sequence
  Description of Artificial Sequence: Synthetic peptide
WNPCWIAQLGDLCDMV

SEQ ID NO: 597 - protein, 16 aa, Artificial Sequence
  Description of Artificial Sequence: Synthetic peptide
WLPCWLAHLGDICDLQ

SEQ ID NO: 598 - protein, 22 aa, Artificial Sequence
  Description of Artificial Sequence: Synthetic peptide
WLSPPSYLPCWMAQLGELCDLV

SEQ ID NO: 599 - protein, 22 aa, Artificial Sequence
  Description of Artificial Sequence: Synthetic peptide
WDVHAIRNPCWLAKLGDLCDLD

SEQ ID NO: 600 - protein, 22 aa, Artificial Sequence
  Description of Artificial Sequence: Synthetic peptide
GAGVLHRWPCWMAKLGDLCDLD

SEQ ID NO: 601 - protein, 22 aa, Artificial Sequence
  Description of Artificial Sequence: Synthetic peptide
DTGRDGWKPCWMALLGELCELE

SEQ ID NO: 602 - protein, 22 aa, Artificial Sequence
  Description of Artificial Sequence: Synthetic peptide
EQGMLGYFPCWKALLGDVCDLD

SEQ ID NO: 603 - protein, 22 aa, Artificial Sequence
  Description of Artificial Sequence: Synthetic peptide
WRVTASLQPCWMAQLGELCDLN

SEQ ID NO: 604 - protein, 22 aa, Artificial Sequence
  Description of Artificial Sequence: Synthetic peptide
GQVVETSLPCWEAQLGELCVLD

SEQ ID NO: 605 - protein, 22 aa, Artificial Sequence
  Description of Artificial Sequence: Synthetic peptide
TVGQFEWYPCSTAQLGELCDLD

SEQ ID NO: 606 - protein, 22 aa, Artificial Sequence
  Description of Artificial Sequence: Synthetic peptide
ALVGGTFYPCYVAHLGELCDIE

SEQ ID NO: 607 - protein, 22 aa, Artificial Sequence
  Description of Artificial Sequence: Synthetic peptide
IDRADGWKPCWIAQVGELCVLE

SEQ ID NO: 608 - protein, 22 aa, Artificial Sequence
  Description of Artificial Sequence: Synthetic peptide
YRRERVEFPCWLAQLGELCDKE

SEQ ID NO: 609 - protein, 22 aa, Artificial Sequence
  Description of Artificial Sequence: Synthetic peptide
AVSHGNWLPCYIAQLGELCDLD

SEQ ID NO: 610 - protein, 22 aa, Artificial Sequence
  Description of Artificial Sequence: Synthetic peptide
IPKGESWFPCWMAAMGELCDLE

SEQ ID NO: 611 - protein, 22 aa, Artificial Sequence
  Description of Artificial Sequence: Synthetic peptide
WYPCWIAQLGEVCDLEKQTGSV

SEQ ID NO: 612 - protein, 22 aa, Artificial Sequence
  Description of Artificial Sequence: Synthetic peptide
WYPCWMAHLGDVCDLESFGQTE

SEQ ID NO: 613 - protein, 22 aa, Artificial Sequence
  Description of Artificial Sequence: Synthetic peptide
YKPCQMAQLGELCDLDVDNKAE

SEQ ID NO: 614 - protein, 22 aa, Artificial Sequence
  Description of Artificial Sequence: Synthetic peptide
FKPCWIANLGELCDMDDERSSE

SEQ ID NO: 615 - protein, 22 aa, Artificial Sequence
  Description of Artificial Sequence: Synthetic peptide
WKPCWMARLGELCDIEDTKVNA

SEQ ID NO: 616 - protein, 22 aa, Artificial Sequence
  Description of Artificial Sequence: Synthetic peptide
SLPCWIARLGELCDLDGYDGEE

SEQ ID NO: 617 - protein, 22 aa, Artificial Sequence
  Description of Artificial Sequence: Synthetic peptide
FYPCWKARLGELCELEELRGYY

SEQ ID NO: 618 - protein, 22 aa, Artificial Sequence
  Description of Artificial Sequence: Synthetic peptide
WKPCWIADLGELCDLAPAWHEY

SEQ ID NO: 619 - protein, 22 aa, Artificial Sequence
  Description of Artificial Sequence: Synthetic peptide
RLPCWRAQLGDLCELDWGLDMG

SEQ ID NO: 620 - protein, 22 aa, Artificial Sequence
  Description of Artificial Sequence: Synthetic peptide
SKPCWMAQLGELCDLDVWNLQM

SEQ ID NO: 621 - protein, 22 aa, Artificial Sequence
  Description of Artificial Sequence: Synthetic peptide
GYPCWLAQLGDYCDLDAGAPSW

SEQ ID NO: 622 - protein, 22 aa, Artificial Sequence
  Description of Artificial Sequence: Synthetic peptide
SWPCWMAQLGDLCDLDGSAGAS

SEQ ID NO: 623 - protein, 22 aa, Artificial Sequence
  Description of Artificial Sequence: Synthetic peptide
WKPCWLAQLGELCDLERPSTTS

SEQ ID NO: 624 - protein, 22 aa, Artificial Sequence
  Description of Artificial Sequence: Synthetic peptide
WYSCGKAQLGELCDLDVESQPG

SEQ ID NO: 625 - protein, 22 aa, Artificial Sequence
  Description of Artificial Sequence: Synthetic peptide
YVPCYMARLGELCELEANRPGQ

SEQ ID NO: 626 - protein, 22 aa, Artificial Sequence
  Description of Artificial Sequence: Synthetic peptide
SKPCWLAQLGDLCDFDWTAADH

SEQ ID NO: 627 - protein, 22 aa, Artificial Sequence
  Description of Artificial Sequence: Synthetic peptide
WFPCWMAQLGDLCELEPDSVPA

SEQ ID NO: 628 - protein, 22 aa, Artificial Sequence
  Description of Artificial Sequence: Synthetic peptide
WTPCWIAHLGDLCDLEPQDDTD

SEQ ID NO: 629 - protein, 22 aa, Artificial Sequence
  Description of Artificial Sequence: Synthetic peptide
WKPCFIASLGELCDLDQGSVEV

SEQ ID NO: 630 - protein, 22 aa, Artificial Sequence
  Description of Artificial Sequence: Synthetic peptide
WKPCWMAALGELCDLERSVGKV

SEQ ID NO: 631 - protein, 22 aa, Artificial Sequence
  Description of Artificial Sequence: Synthetic peptide
WKPCWRAQLGELCDLELGPSER

SEQ ID NO: 632 - protein, 22 aa, Artificial Sequence
  Description of Artificial Sequence: Synthetic peptide
FFPCWMGQLGDLCDLEVRSMQK

SEQ ID NO: 633 - protein, 22 aa, Artificial Sequence
  Description of Artificial Sequence: Synthetic peptide
YWPCSMASLGELCDLEWQGRLP

SEQ ID NO: 634 - protein, 22 aa, Artificial Sequence
  Description of Artificial Sequence: Synthetic peptide
WYPCYMASLGELCDLQSSISPR

SEQ ID NO: 635 - protein, 22 aa, Artificial Sequence
  Description of Artificial Sequence: Synthetic peptide
WYPCWMAQLGELCDHEWPSYGA

SEQ ID NO: 636 - protein, 22 aa, Artificial Sequence
  Description of Artificial Sequence: Synthetic peptide
MGSWLPCWMAQLGDLCDVEGGM

SEQ ID NO: 637 - protein, 22 aa, Artificial Sequence
  Description of Artificial Sequence: Synthetic peptide
QKGFLPCWRAQLGQLCDMESQY

SEQ ID NO: 638 - protein, 22 aa, Artificial Sequence
  Description of Artificial Sequence: Synthetic peptide
GSGWQPCWMADLGELCDLDNEK

SEQ ID NO: 639 - protein, 22 aa, Artificial Sequence
  Description of Artificial Sequence: Synthetic peptide
WRRWYPCWMAQLGELCDLDQWT

SEQ ID NO: 640 - protein, 22 aa, Artificial Sequence
  Description of Artificial Sequence: Synthetic peptide
RRSWYPCRIAQLGELCDLDPRV

SEQ ID NO: 641 - protein, 22 aa, Artificial Sequence
  Description of Artificial Sequence: Synthetic peptide
AYRIYPCWKAQLGELCDLDNAD

SEQ ID NO: 642 - protein, 22 aa, Artificial Sequence
  Description of Artificial Sequence: Synthetic peptide
QRNSFPCWLAQLGDLCDLGDWA

SEQ ID NO: 643 - protein, 22 aa, Artificial Sequence
  Description of Artificial Sequence: Synthetic peptide
QPAWLPCWLAQLGELCDLGTGA

SEQ ID NO: 644 - protein, 22 aa, Artificial Sequence
  Description of Artificial Sequence: Synthetic peptide
SRFWQPCWMAQLGELCHLDPQM

SEQ ID NO: 645 - protein, 22 aa, Artificial Sequence
  Description of Artificial Sequence: Synthetic peptide
YLNFNPCWTAQLGELCDLASGE

SEQ ID NO: 646 - protein, 22 aa, Artificial Sequence
  Description of Artificial Sequence: Synthetic peptide
STGWYPCWIAEFGELCDLVKPH

SEQ ID NO: 647 - protein, 22 aa, Artificial Sequence
  Description of Artificial Sequence: Synthetic peptide
AHWSQPCWTAQLGELCDLDMGD

SEQ ID NO: 648 - protein, 22 aa, Artificial Sequence
  Description of Artificial Sequence: Synthetic peptide
HPVRYPCWVAQLGELCDLENGN

SEQ ID NO: 649 - protein, 22 aa, Artificial Sequence
  Description of Artificial Sequence: Synthetic peptide
QTGSYPCWIAHLGELCDLEGSA

SEQ ID NO: 650 - protein, 21 aa, Artificial Sequence
  Description of Artificial Sequence: Synthetic peptide
TGWWYPCWMAQLGELCDLQQT

SEQ ID NO: 651 - protein, 19 aa, Artificial Sequence
  Description of Artificial Sequence: Synthetic peptide
DLWQPCWMARLGELCDLKG

SEQ ID NO: 652 - protein, 20 aa, Artificial Sequence
  Description of Artificial Sequence: Synthetic peptide
MGTGWQNYCRYAQLGELCLL

SEQ ID NO: 653 - protein, 16 aa, Artificial Sequence
  Description of Artificial Sequence: Synthetic peptide
WYPCGVAQPGDLCDLE

SEQ ID NO: 654 - protein, 22 aa, Artificial Sequence
  Description of Artificial Sequence: Synthetic peptide
MLGEWLCEMDQLGYLCYLDHGD

SEQ ID NO: 655 - protein, 20 aa, Artificial Sequence
  Description of Artificial Sequence: Synthetic peptide
WDGWECGMDHDGWVCEFWGE

SEQ ID NO: 656-660 - skipped (5 entries)

SEQ ID NO: 661 - protein, 19 aa, Artificial Sequence
  Description of Artificial Sequence: Synthetic peptide
  MOD_RES (1)..(1): A, D, E, F, G, H, I, K, L, M, N, P, Q, R, S, T, V, W, or Y
  MOD_RES (2)..(2): C, D, F, G, I, L, M, R, S, V, W, or Y
  MOD_RES (3)..(3): A, D, F, H, K, L, N, P, Q, R, S, T, V, W, or Y
  MOD_RES (4)..(4): A, D, F, L, N, P, Q, S, T, or W
  MOD_RES (6)..(6): D, E, F, G, L, M, Q, R, S, W, or Y
  MOD_RES (7)..(7): A, F, I, K, L, M, N, Q, R, S, V, W, or Y
  MOD_RES (8)..(8): A, D, E, I, S, T, V, or W
  MOD_RES (9)..(9): A, E, F, G, H, K, L, N, P, Q, R, S, V, W, or Y
  MOD_RES (10)..(10): A, E, I, L, M, P, Q V, or W
  MOD_RES (11)..(11): F, G, or V
  MOD_RES (12)..(12): D, E, N, P, Q, S, V, W, or Y
  MOD_RES (13)..(13): D, F, H, I, L, M, Q, S, T, V, W, or X
  MOD_RES (15)..(15): A, D, E, L, N, Q, S, T, or V
  MOD_RES (16)..(16): A, E, F, I, K, L, M, Q, R S, T V, or W
  MOD_RES (17)..(17): A, D, E, F, G, I, K, L, N, P, Q, R, T, V, W, or Y
  MOD_RES (18)..(18): A, C, D, E, F, G, H, I, L, M, N, P, Q, R, S, T, V, W, or Y
  MOD_RES (19)..(19): A, D, E, F, G, H, I, K, L, M N, P, Q, R, S, T, V, W, or Y
XXXXCXXXXXXXXCXXXXX

SEQ ID NO: 662 - protein, 16 aa, Artificial Sequence
  Description of Artificial Sequence: Synthetic peptide
  MOD_RES (1)..(1): C, D, F, G, I, L, M, R, S, V, W, or Y
  MOD_RES (2)..(2): A, D, F, H, K, L, N, P, Q, R, S, T, V, W, or Y
  MOD_RES (3)..(3): A, D, F, L, N, P, Q, S, T, or W
  MOD_RES (5)..(5): D, E, F, G, L, M, Q, R, S, W, or Y
  MOD_RES (6)..(6): A, F, I, K, L, M, N, Q, R, S, V, W, or Y
  MOD_RES (7)..(7): A, D, E, I, S, T, V, or W
  MOD_RES (8)..(8): A, E, F, G, H, K, L, N, P, Q, R, S, V, W, or Y
  MOD_RES (9)..(9): A, E, I, L, M, P, Q V, or W
  MOD_RES (10)..(10): F, G, or V
  MOD_RES (11)..(11): D, E, N, P, Q, S, V, W, or Y
  MOD_RES (12)..(12): D, F, H, I, L, M, Q, S, T, V, W, or X
  MOD_RES (14)..(14): A, D, E, L, N, Q, S, T, or V
  MOD_RES (15)..(15): A, E, F, I, K, L, M, Q, R S, T V, or W
  MOD_RES (16)..(16): A, D, E, F, G, I, K, L, N, P, Q, R, T, V, W, or Y
XXXCXXXXXXXXCXXX

SEQ ID NO: 663 - protein, 14 aa, Artificial Sequence
  Description of Artificial Sequence: Synthetic peptide
  MOD_RES (1)..(1): A, D, F, H, K, L, N, P, Q, R, S, T, V, W, or Y
  MOD_RES (2)..(2): A, D, F, L, N, P, Q, S, T, or W
  MOD_RES (4)..(4): D, E, F, G, L, M, Q, R, S, W, or Y
  MOD_RES (5)..(5): A, F, I, K, L, M, N, Q, R, S, V, W, or Y
  MOD_RES (6)..(6): A, D, E, I, S, T, V, or W
  MOD_RES (7)..(7): A, E, F, G, H, K, L, N, P, Q, R, S, V, W, or Y
  MOD_RES (8)..(8): A, E, I, L, M, P, Q V, or W
  MOD_RES (9)..(9): F, G, or V
  MOD_RES (10)..(10): D, E, N, P, Q, S, V, W, or Y
  MOD_RES (11)..(11): D, F, H, I, L, M, Q, S, T, V, W, or X
  MOD_RES (13)..(13): A, D, E, L, N, Q, S, T, or V
  MOD_RES (14)..(14): A, E, F, I, K, L, M, Q, R S, T V, or W
XXCXXXXXXXXCXX

SEQ ID NO: 664 - protein, 12 aa, Artificial Sequence
  Description of Artificial Sequence: Synthetic peptide
  MOD_RES (1)..(1): A, D, F, L, N, P, Q, S, T, or W
  MOD_RES (3)..(3): D, E, F, G, L, M, Q, R, S, W, or Y
  MOD_RES (4)..(4): A, F, I, K, L, M, N, Q, R, S, V, W, or Y
  MOD_RES (5)..(5): A, D, E, I, S, T, V, or W
  MOD_RES (6)..(6): A, E, F, G, H, K, L, N, P, Q, R, S, V, W, or Y
  MOD_RES (7)..(7): A, E, I, L, M, P, Q V, or W
  MOD_RES (8)..(8): F, G, or V
  MOD_RES (9)..(9): D, E, N, P, Q, S, V, W, or Y
  MOD_RES (10)..(10): D, F, H, I, L, M, Q, S, T, V, W, or X
  MOD_RES (12)..(12): A, D, E, L, N, Q, S, T, or V
XCXXXXXXXXCX

SEQ ID NO: 665 - protein, 10 aa, Artificial Sequence
  Description of Artificial Sequence: Synthetic peptide
  MOD_RES (2)..(2): D, E, F, G, L, M, Q, R, S, W, or Y
  MOD_RES (3)..(3): A, F, I, K, L, M, N, Q, R, S, V, W, or Y
  MOD_RES (4)..(4): A, D, E, I, S, T, V, or W
  MOD_RES (5)..(5): A, E, F, G, H, K, L, N, P, Q, R, S, V, W, or Y
  MOD_RES (6)..(6): A, E, I, L, M, P, Q V, or W
  MOD_RES (7)..(7): F, G, or V
  MOD_RES (8)..(8): D, E, N, P, Q, S, V, W, or Y
  MOD_RES (9)..(9): D, F, H, I, L, M, Q, S, T, V, W, or X
CXXXXXXXXC

SEQ ID NO: 666 - protein, 8 aa, Artificial Sequence
  Description of Artificial Sequence: Synthetic peptide
  MOD_RES (1)..(1): D, E, F, G, L, M, Q, R, S, W, or Y
  MOD_RES (2)..(2): A, F, I, K, L, M, N, Q, R, S, V, W, or Y
  MOD_RES (3)..(3): A, D, E, I, S, T, V, or W
  MOD_RES (4)..(4): A, E, F, G, H, K, L, N, P, Q, R, S, V, W, or Y
  MOD_RES (5)..(5): A, E, I, L, M, P, Q V, or W
  MOD_RES (6)..(6): F, G, or V
  MOD_RES (7)..(7): D, E, N, P, Q, S, V, W, or Y
  MOD_RES (8)..(8): D, F, H, I, L, M, Q, S, T, V, W, or X
XXXXXXXX

SEQ ID NO: 667 - protein, 22 aa, Artificial Sequence
  Description of Artificial Sequence: Synthetic peptide
WYPCWIAQLGELCDLDAKGQRR

SEQ ID NO: 668 - protein, 22 aa, Artificial Sequence
  Description of Artificial Sequence: Synthetic peptide
TNNFYPCWLAKLGDLCDFDDLN

SEQ ID NO: 669 - protein, 22 aa, Artificial Sequence
  Description of Artificial Sequence: Synthetic peptide
WYPCWIARVGELCDLEEGPVNR

SEQ ID NO: 670 - protein, 21 aa, Artificial Sequence
  Description of Artificial Sequence: Synthetic peptide
AVEFYPCWLARIGELCDLVEP

SEQ ID NO: 671 - protein, 16 aa, Artificial Sequence
  Description of Artificial Sequence: Synthetic peptide
WYPCWIAHLGELCDLE

SEQ ID NO: 672 - protein, 16 aa, Artificial Sequence
  Description of Artificial Sequence: Synthetic peptide
WYPCWIARVGELCDME

SEQ ID NO: 673 - protein, 21 aa, Artificial Sequence
  Description of Artificial Sequence: Synthetic peptide
RREWYPCWIAQVGELCDLPLI

SEQ ID NO: 674 - protein, 22 aa, Artificial Sequence
  Description of Artificial Sequence: Synthetic peptide
RWPWYPCEIARIGELCDLEQAN

SEQ ID NO: 675 - protein, 22 aa, Artificial Sequence
  Description of Artificial Sequence: Synthetic peptide
FGAFYPCWKAQLGELCDLEPVT

SEQ ID NO: 676 - protein, 22 aa, Artificial Sequence
  Description of Artificial Sequence: Synthetic peptide
HGRWFPCWMAQVGDLCDLEHSN

SEQ ID NO: 677 - protein, 22 aa, Artificial Sequence
  Description of Artificial Sequence: Synthetic peptide
WYPCWLAKLGELCDLDRAEALP

SEQ ID NO: 678 - protein, 20 aa, Artificial Sequence
  Description of Artificial Sequence: Synthetic peptide
VWFPCWFAQLGDLCDLDQDP

SEQ ID NO: 679 - protein, 22 aa, Artificial Sequence
  Description of Artificial Sequence: Synthetic peptide
ETLGSVWYPCWIASIGELCDLD

SEQ ID NO: 680 - protein, 22 aa, Artificial Sequence
  Description of Artificial Sequence: Synthetic peptide
WYSCWIAQLGELCDLDDMGDRV

SEQ ID NO: 681 - protein, 16 aa, Artificial Sequence
  Description of Artificial Sequence: Synthetic peptide
WFPCWLAQLGELCDKE

SEQ ID NO: 682 - protein, 16 aa, Artificial Sequence
  Description of Artificial Sequence: Synthetic peptide
WYPCWIAQLGELCDLV

SEQ ID NO: 683 - protein, 22 aa, Artificial Sequence
  Description of Artificial Sequence: Synthetic peptide
SHLWFPCWMAQLGELCDLEGGP

SEQ ID NO: 684 - protein, 21 aa, Artificial Sequence
  Description of Artificial Sequence: Synthetic peptide
RRWLPCWMAHVGELCDLELGN

SEQ ID NO: 685 - protein, 21 aa, Artificial Sequence
  Description of Artificial Sequence: Synthetic peptide
YWCWFARVGELCDLDDGGVPS

SEQ ID NO: 686 - protein, 16 aa, Artificial Sequence
  Description of Artificial Sequence: Synthetic peptide
WYSCWIAQIGELCDLE

SEQ ID NO: 687 - protein, 22 aa, Artificial Sequence
  Description of Artificial Sequence: Synthetic peptide
MNPVGTFYPCWIAKLGELCDLQ

SEQ ID NO: 688 - protein, 22 aa, Artificial Sequence
  Description of Artificial Sequence: Synthetic peptide
HGGVIGWYPCWMAKVGELCDLD

SEQ ID NO: 689 - protein, 22 aa, Artificial Sequence
  Description of Artificial Sequence: Synthetic peptide
WYPCSIALLGELCDLESVHEKS

SEQ ID NO: 690 - protein, 22 aa, Artificial Sequence
  Description of Artificial Sequence: Synthetic peptide
EQRNRQWWPCWLARLGDLCDLD

SEQ ID NO: 691 - protein, 16 aa, Artificial Sequence
  Description of Artificial Sequence: Synthetic peptide
WYPCWLAQLGELCDLD

SEQ ID NO: 692 - protein, 16 aa, Artificial Sequence
  Description of Artificial Sequence: Synthetic peptide
WLPCWMAHLGDLCDLE

SEQ ID NO: 693 - protein, 22 aa, Artificial Sequence
  Description of Artificial Sequence: Synthetic peptide
RPSWAPCWLAQVGELCDLDHPE

SEQ ID NO: 694 - protein, 22 aa, Artificial Sequence
  Description of Artificial Sequence: Synthetic peptide
ESKEPAFWPCWMAQLGDLCDLE

SEQ ID NO: 695 - protein, 22 aa, Artificial Sequence
  Description of Artificial Sequence: Synthetic peptide
RSLRESWFPCWMAKLGDLCDLE

SEQ ID NO: 696 - protein, 16 aa, Artificial Sequence
  Description of Artificial Sequence: Synthetic peptide
WHPCWLARVGDLCDLD

SEQ ID NO: 697 - protein, 22 aa, Artificial Sequence
  Description of Artificial Sequence: Synthetic peptide
SRSAGEYYPCWLAQLGELCDLA

SEQ ID NO: 698 - protein, 22 aa, Artificial Sequence
  Description of Artificial Sequence: Synthetic peptide
RQVPKQWYPCWMAALGELCDLE

SEQ ID NO: 699 - protein, 16 aa, Artificial Sequence
  Description of Artificial Sequence: Synthetic peptide
WYPCWLAHLGELCDLE

SEQ ID NO: 700 - protein, 21 aa, Artificial Sequence
  Description of Artificial Sequence: Synthetic peptide
QVMRLWYPCWMAQLGELCDLE

SEQ ID NO: 701 - protein, 22 aa, Artificial Sequence
  Description of Artificial Sequence: Synthetic peptide
WYPCWMAQLGELCDLDEAPVQP

SEQ ID NO: 702 - protein, 22 aa, Artificial Sequence
  Description of Artificial Sequence: Synthetic peptide
RDIWWPCWVAQLGELCDLDDPQ

SEQ ID NO: 703 - protein, 22 aa, Artificial Sequence
  Description of Artificial Sequence: Synthetic peptide
SATWYPCFLANLGELCDLEQEN

SEQ ID NO: 704 - protein, 22 aa, Artificial Sequence
  Description of Artificial Sequence: Synthetic peptide
YAEWYPCWMARVGEVCDLEVTP

SEQ ID NO: 705 - protein, 22 aa, Artificial Sequence
  Description of Artificial Sequence: Synthetic peptide
RSGDKAFFPCWLAQLGDLCDLD

SEQ ID NO: 706 - protein, 16 aa, Artificial Sequence
  Description of Artificial Sequence: Synthetic peptide
WYPCWMAQLGELCDMD

SEQ ID NO: 707 - protein, 21 aa, Artificial Sequence
  Description of Artificial Sequence: Synthetic peptide
RVSYPCWLARLGELCDMDLEE

SEQ ID NO: 708 - protein, 22 aa, Artificial Sequence
  Description of Artificial Sequence: Synthetic peptide
TESWYPCWLANLGDLCDLEWSA

SEQ ID NO: 709 - protein, 16 aa, Artificial Sequence
  Description of Artificial Sequence: Synthetic peptide
WLPCWMADVGDLCDLD

SEQ ID NO: 710 - protein, 16 aa, Artificial Sequence
  Description of Artificial Sequence: Synthetic peptide
WHPCWMARLGELCDLD

SEQ ID NO: 711 - protein, 22 aa, Artificial Sequence
  Description of Artificial Sequence: Synthetic peptide
QGTKWHWNPCWMAQLGELCDLD

SEQ ID NO: 712 - protein, 22 aa, Artificial Sequence
  Description of Artificial Sequence: Synthetic peptide
KNGPKSWYPCWMAQVGDLCDLD

SEQ ID NO: 713 - protein, 22 aa, Artificial Sequence
  Description of Artificial Sequence: Synthetic peptide
SGTGPAWYPCFLASLGQLCDLE

SEQ ID NO: 714 - protein, 16 aa, Artificial Sequence
  Description of Artificial Sequence: Synthetic peptide
WYPCWMARMGELCDLE

SEQ ID NO: 715 - protein, 16 aa, Artificial Sequence
  Description of Artificial Sequence: Synthetic peptide
WLPCWRAQLGQLCDLD

SEQ ID NO: 716 - protein, 16 aa, Artificial Sequence
  Description of Artificial Sequence: Synthetic peptide
LFPCWLAQLGELCDLE

SEQ ID NO: 717 - protein, 16 aa, Artificial Sequence
  Description of Artificial Sequence: Synthetic peptide
RYPCWIAQLGELCDLD

SEQ ID NO: 718 - protein, 16 aa, Artificial Sequence
  Description of Artificial Sequence: Synthetic peptide
WHPCWIAHLGELCDLE

SEQ ID NO: 719 - protein, 16 aa, Artificial Sequence
  Description of Artificial Sequence: Synthetic peptide
MYPCWIAHLGELCDLD

SEQ ID NO: 720 - protein, 16 aa, Artificial Sequence
  Description of Artificial Sequence: Synthetic peptide
WYPCSIASLGELCDLE

SEQ ID NO: 721 - protein, 16 aa, Artificial Sequence
  Description of Artificial Sequence: Synthetic peptide
WLPCYMAQLGDLCDLE

SEQ ID NO: 722 - protein, 16 aa, Artificial Sequence
  Description of Artificial Sequence: Synthetic peptide
WHPCWMAQVGEVCDLD

SEQ ID NO: 723 - protein, 16 aa, Artificial Sequence
  Description of Artificial Sequence: Synthetic peptide
WYPCWLASLGEVCDLE

SEQ ID NO: 724 - protein, 16 aa, Artificial Sequence
  Description of Artificial Sequence: Synthetic peptide
WWPCSIARLGQLCDLD

SEQ ID NO: 725 - protein, 16 aa, Artificial Sequence
  Description of Artificial Sequence: Synthetic peptide
WYPCWLAHLGELCDLA

SEQ ID NO: 726 - protein, 16 aa, Artificial Sequence
  Description of Artificial Sequence: Synthetic peptide
WYPCWLAQLGELCDAE

SEQ ID NO: 727 - protein, 16 aa, Artificial Sequence
  Description of Artificial Sequence: Synthetic peptide
WKPCWMALLGELCDLE

SEQ ID NO: 728 - protein, 16 aa, Artificial Sequence
  Description of Artificial Sequence: Synthetic peptide
RYPCWRAKLGELCDLD

SEQ ID NO: 729 - protein, 22 aa, Artificial Sequence
  Description of Artificial Sequence: Synthetic peptide
EEQSRGFLPCWMALLGELCDLD

SEQ ID NO: 730 - protein, 22 aa, Artificial Sequence
  Description of Artificial Sequence: Synthetic peptide
LGSKRQWYPCWVAHLGELCDLE

SEQ ID NO: 731 - protein, 22 aa, Artificial Sequence
  Description of Artificial Sequence: Synthetic peptide
ESEGRGWYPCWNALLGELCDLE

SEQ ID NO: 732 - protein, 22 aa, Artificial Sequence
  Description of Artificial Sequence: Synthetic peptide
RWTQAQWYPCWLAQLGELCDLE

SEQ ID NO: 733 - protein, 21 aa, Artificial Sequence
  Description of Artificial Sequence: Synthetic peptide
LHAGRWNPCWLAQLGELCDLE

SEQ ID NO: 734 - protein, 21 aa, Artificial Sequence
  Description of Artificial Sequence: Synthetic peptide
LSSKGWYPCWKARLGDLCDLE

SEQ ID NO: 735 - protein, 22 aa, Artificial Sequence
  Description of Artificial Sequence: Synthetic peptide
DMFTHRWYPCSMAKLGELCDLE

SEQ ID NO: 736 - protein, 22 aa, Artificial Sequence
  Description of Artificial Sequence: Synthetic peptide
MTDRAFWNPCWVARLGELCDLD

SEQ ID NO: 737 - protein, 22 aa, Artificial Sequence
  Description of Artificial Sequence: Synthetic peptide
NVTYTQWFPCWLARLGELCDLV

SEQ ID NO: 738 - protein, 21 aa, Artificial Sequence
  Description of Artificial Sequence: Synthetic peptide
VRTRIWYPCWSAQLGELCDLD

SEQ ID NO: 739 - protein, 21 aa, Artificial Sequence
  Description of Artificial Sequence: Synthetic peptide
AMARRYLPCWIAKLGELCELD

SEQ ID NO: 740 - protein, 22 aa, Artificial Sequence
  Description of Artificial Sequence: Synthetic peptide
ARGEYRWFPCWMARLGELCDLE

SEQ ID NO: 741 - protein, 22 aa, Artificial Sequence
  Description of Artificial Sequence: Synthetic peptide
YLERSRWYPCFIAQLGELCDLE

SEQ ID NO: 742 - protein, 22 aa, Artificial Sequence
  Description of Artificial Sequence: Synthetic peptide
FRVSRDWFPCWMAQLGEVCDLE

SEQ ID NO: 743 - protein, 22 aa, Artificial Sequence
  Description of Artificial Sequence: Synthetic peptide
IERAWEWRPCWLASVGELCDLE

SEQ ID NO: 744 - protein, 21 aa, Artificial Sequence
  Description of Artificial Sequence: Synthetic peptide
VASERFYPCWIARLGELCDVE

SEQ ID NO: 745 - protein, 22 aa, Artificial Sequence
  Description of Artificial Sequence: Synthetic peptide
WYPCWIAKLGEVCDLDQGTTRQ

SEQ ID NO: 746 - protein, 22 aa, Artificial Sequence
  Description of Artificial Sequence: Synthetic peptide
WYPCWLAHLGELCDLDWKGRND

SEQ ID NO: 747 - protein, 22 aa, Artificial Sequence
  Description of Artificial Sequence: Synthetic peptide
WYPCWRAQLGELCDLVDLGSHL

SEQ ID NO: 748 - protein, 22 aa, Artificial Sequence
  Description of Artificial Sequence: Synthetic peptide
WSPCWMASLGDLCDLEETRQTE

SEQ ID NO: 749 - protein, 22 aa, Artificial Sequence
  Description of Artificial Sequence: Synthetic peptide
WTPCWIAQLGELCDLEGRHGTV

SEQ ID NO: 750 - protein, 21 aa, Artificial Sequence
  Description of Artificial Sequence: Synthetic peptide
LPCWIAQLGDLCDLEPEPSPE

SEQ ID NO: 751 - protein, 22 aa, Artificial Sequence
  Description of Artificial Sequence: Synthetic peptide
FYPCWAAHLGDLCDLEYQEAGP

SEQ ID NO: 752 - protein, 22 aa, Artificial Sequence
  Description of Artificial Sequence: Synthetic peptide
WLPCWLAPLGDLCDMDMSAVMN

SEQ ID NO: 753 - protein, 22 aa, Artificial Sequence
  Description of Artificial Sequence: Synthetic peptide
WRPCWMAHLGDLCDLEMANENP

SEQ ID NO: 754 - protein, 22 aa, Artificial Sequence
  Description of Artificial Sequence: Synthetic peptide
WYPCWLAQLGEVCDLDDGGGVF

SEQ ID NO: 755 - protein, 22 aa, Artificial Sequence
  Description of Artificial Sequence: Synthetic peptide
WWPCWLAQLGELCDLEVNGSLI

SEQ ID NO: 756 - protein, 22 aa, Artificial Sequence
  Description of Artificial Sequence: Synthetic peptide
TEMWYPCWMAYQGELCDLDMTY

SEQ ID NO: 757 - protein, 22 aa, Artificial Sequence
  Description of Artificial Sequence: Synthetic peptide
ARTWWPCWRAKLGELCDLVVPE

SEQ ID NO: 758 - protein, 22 aa, Artificial Sequence
  Description of Artificial Sequence: Synthetic peptide
HQGFYSCRLARLGELCDLDTGW

SEQ ID NO: 759 - protein, 22 aa, Artificial Sequence
  Description of Artificial Sequence: Synthetic peptide
VDEFYPCSMAGLGELCDLERQN

SEQ ID NO: 760 - protein, 22 aa, Artificial Sequence
  Description of Artificial Sequence: Synthetic peptide
AWDWYPCSVAALGEICDLDIQD

SEQ ID NO: 761 - protein, 22 aa, Artificial Sequence
  Description of Artificial Sequence: Synthetic peptide
RPPWYPCWMARLGEVCDMDIML

SEQ ID NO: 762 - protein, 22 aa, Artificial Sequence
  Description of Artificial Sequence: Synthetic peptide
SQRWYPCWVAHLGELCDLEGVV

SEQ ID NO: 763 - protein, 22 aa, Artificial Sequence
  Description of Artificial Sequence: Synthetic peptide
KGSWQPCWFAKLGELCDLHPTS

SEQ ID NO: 764 - protein, 22 aa, Artificial Sequence
  Description of Artificial Sequence: Synthetic peptide
QTWYLPCWMAKLGELCDLGERD

SEQ ID NO: 765 - protein, 22 aa, Artificial Sequence
  Description of Artificial Sequence: Synthetic peptide
EPRWYPCWMAQMGELCDMEMSD

SEQ ID NO: 766 - protein, 22 aa, Artificial Sequence
  Description of Artificial Sequence: Synthetic peptide
WGGRYWCWMAKLGDLCDLEDEW

SEQ ID NO: 767 - protein, 22 aa, Artificial Sequence
  Description of Artificial Sequence: Synthetic peptide
WWPCWIAQVGELCDLDGPGRPT

SEQ ID NO: 768 - protein, 19 aa, Artificial Sequence
  Description of Artificial Sequence: Synthetic peptide
RLVYDCLFAQVGDLCEVIS

SEQ ID NO: 769 - protein, 20 aa, Artificial Sequence
  Description of Artificial Sequence: Synthetic peptide
WRILWMQQCWRSHVVNQCAL

SEQ ID NO: 770 - protein, 22 aa, Artificial Sequence
  Description of Artificial Sequence: Synthetic peptide
WYPCWIAQVGELCDLDEVSHGR

SEQ ID NO: 771 - protein, 22 aa, Artificial Sequence
  Description of Artificial Sequence: Synthetic peptide
TGEWWPCWVAEVGELCDLERGP

SEQ ID NO: 772 - protein, 20 aa, Artificial Sequence
  Description of Artificial Sequence: Synthetic peptide
ARTQGWYDCLFAQVGELCDL

SEQ ID NO: 773 - protein, 22 aa, Artificial Sequence
  Description of Artificial Sequence: Synthetic peptide
FHPCWRALLGELCDLETALGPS

SEQ ID NO: 774 - protein, 20 aa, Artificial Sequence
  Description of Artificial Sequence: Synthetic peptide
LQIRKLWACRIDLVGPFCLL

SEQ ID NO: 775 - protein, 20 aa, Artificial Sequence
  Description of Artificial Sequence: Synthetic peptide
AEYSGRYDCYIAKVGELCDI

SEQ ID NO: 776 - protein, 20 aa, Artificial Sequence
  Description of Artificial Sequence: Synthetic peptide
SWRFLWQDCGRAHVGELCDL

SEQ ID NO: 777 - protein, 22 aa, Artificial Sequence
  Description of Artificial Sequence: Synthetic peptide
NRWWHPCWMARVGELCDLEPDA

SEQ ID NO: 778 - protein, 22 aa, Artificial Sequence
  Description of Artificial Sequence: Synthetic peptide
WWPCWVAKLGELCDLEGDASRV

SEQ ID NO: 779 - protein, 22 aa, Artificial Sequence
  Description of Artificial Sequence: Synthetic peptide
WYPCEFAQLGELCDLLPFPYPA

SEQ ID NO: 780 - protein, 20 aa, Artificial Sequence
  Description of Artificial Sequence: Synthetic peptide
SYMHDCFMAQVGDLCDRFIS

SEQ ID NO: 781 - protein, 22 aa, Artificial Sequence
  Description of Artificial Sequence: Synthetic peptide
WWPCWIAQVGELCDLEEESRES

SEQ ID NO: 782 - protein, 22 aa, Artificial Sequence
  Description of Artificial Sequence: Synthetic peptide
KWAWNPCYIARLGELCDLVEPE

SEQ ID NO: 783 - protein, 22 aa, Artificial Sequence
  Description of Artificial Sequence: Synthetic peptide
WWPCWIADLGELCDLEGPPRGR

SEQ ID NO: 784 - protein, 20 aa, Artificial Sequence
  Description of Artificial Sequence: Synthetic peptide
PTLITWYDCLFAEVGELCDM

SEQ ID NO: 785 - protein, 20 aa, Artificial Sequence
  Description of Artificial Sequence: Synthetic peptide
EISNWFLDCMFADVGDLCDL

SEQ ID NO: 786 - protein, 22 aa, Artificial Sequence
  Description of Artificial Sequence: Synthetic peptide
AQVWYPCWLAKVGELCDLDQWN

SEQ ID NO: 787 - protein, 22 aa, Artificial Sequence
  Description of Artificial Sequence: Synthetic peptide
FGGKMDWYPCWIANLGELCDLK

SEQ ID NO: 788 - protein, 22 aa, Artificial Sequence
  Description of Artificial Sequence: Synthetic peptide
WFPCWMAKVGDLCDVDEHQDPS

SEQ ID NO: 789 - protein, 22 aa, Artificial Sequence
  Description of Artificial Sequence: Synthetic peptide
MGDSSSWFPCWMAQLGELCDME

SEQ ID NO: 790 - protein, 22 aa, Artificial Sequence
  Description of Artificial Sequence: Synthetic peptide
MFRYYPCWIASIGELCDLEWGV

SEQ ID NO: 791 - protein, 22 aa, Artificial Sequence
  Description of Artificial Sequence: Synthetic peptide
ERRWYPCWLASVGELCDLDMGD

SEQ ID NO: 792 - protein, 16 aa, Artificial Sequence
  Description of Artificial Sequence: Synthetic peptide
WYPCWVAQLGELCDLE

SEQ ID NO: 793 - protein, 22 aa, Artificial Sequence
  Description of Artificial Sequence: Synthetic peptide
RWDYWPCYIAQVGELCDLEVYE

SEQ ID NO: 794 - protein, 22 aa, Artificial Sequence
  Description of Artificial Sequence: Synthetic peptide
SLAHRSWYPCWLAQVGELCDLD

SEQ ID NO: 795 - protein, 22 aa, Artificial Sequence
  Description of Artificial Sequence: Synthetic peptide
QNASKGWYPCWIAHVGELCDWD

SEQ ID NO: 796 - protein, 21 aa, Artificial Sequence
  Description of Artificial Sequence: Synthetic peptide
HRWYPCWLAHLGELCDLDPMS

SEQ ID NO: 797 - protein, 16 aa, Artificial Sequence
  Description of Artificial Sequence: Synthetic peptide
FYPCWIAFVGELCDLE

SEQ ID NO: 798 - protein, 20 aa, Artificial Sequence
  Description of Artificial Sequence: Synthetic peptide
EGHWYPCWIAQLGELCDLDW

SEQ ID NO: 799 - protein, 22 aa, Artificial Sequence
  Description of Artificial Sequence: Synthetic peptide
WTGWSAFYPCSIANLGELCDLD

SEQ ID NO: 800 - protein, 22 aa, Artificial Sequence
  Description of Artificial Sequence: Synthetic peptide
WEKLQNWYPCWIAQMGELCDLE

SEQ ID NO: 801 - protein, 22 aa, Artificial Sequence
  Description of Artificial Sequence: Synthetic peptide
TNGVLDWWPCWMAQVGELCDLD

SEQ ID NO: 802 - protein, 16 aa, Artificial Sequence
  Description of Artificial Sequence: Synthetic peptide
WYPCWVAKLGELCDLE

SEQ ID NO: 803 - protein, 19 aa, Artificial Sequence
  Description of Artificial Sequence: Synthetic peptide
AYYPCELAQLGELCDLYNI

SEQ ID NO: 804 - protein, 16 aa, Artificial Sequence
  Description of Artificial Sequence: Synthetic peptide
WYPCWMAHLGELCDLE

SEQ ID NO: 805 - protein, 21 aa, Artificial Sequence
  Description of Artificial Sequence: Synthetic peptide
NDHTAWWPCYFAQVGDLCDLV

SEQ ID NO: 806 - protein, 22 aa, Artificial Sequence
  Description of Artificial Sequence: Synthetic peptide
WWPCEIAQIGELCDLEWVRHAE

SEQ ID NO: 807 - protein, 22 aa, Artificial Sequence
  Description of Artificial Sequence: Synthetic peptide
WWPCDFAQIGELCDLGPRFTGE

SEQ ID NO: 808 - protein, 22 aa, Artificial Sequence
  Description of Artificial Sequence: Synthetic peptide
RDWWLPCEFALIGELCDLERSW

SEQ ID NO: 809 - protein, 20 aa, Artificial Sequence
  Description of Artificial Sequence: Synthetic peptide
MRTTFWYDCYIAQVGELCDF

SEQ ID NO: 810 - protein, 22 aa, Artificial Sequence
  Description of Artificial Sequence: Synthetic peptide
SWHAETWYPCWLAQVGELCDLD

SEQ ID NO: 811 - protein, 20 aa, Artificial Sequence
  Description of Artificial Sequence: Synthetic peptide
EWFHDCFLAKVGDLCDLFLW

SEQ ID NO: 812 - protein, 22 aa, Artificial Sequence
  Description of Artificial Sequence: Synthetic peptide
SGKTQMWNPCYVAKVGELCDLV

SEQ ID NO: 813 - protein, 22 aa, Artificial Sequence
  Description of Artificial Sequence: Synthetic peptide
DKAGPNFYPCWLAHVGELCDQA

SEQ ID NO: 814 - protein, 22 aa, Artificial Sequence
  Description of Artificial Sequence: Synthetic peptide
AGFRGRWWPCEYAQVGELCDLE

SEQ ID NO: 815 - protein, 22 aa, Artificial Sequence
  Description of Artificial Sequence: Synthetic peptide
WFPCWLAKVGELCDRDDLAGPS

SEQ ID NO: 816 - protein, 16 aa, Artificial Sequence
  Description of Artificial Sequence: Synthetic peptide
WWPCEWARIGELCDLE

SEQ ID NO: 817 - protein, 20 aa, Artificial Sequence
  Description of Artificial Sequence: Synthetic peptide
KGSSWFPCYFAQVGDLCDLY

SEQ ID NO: 818 - protein, 16 aa, Artificial Sequence
  Description of Artificial Sequence: Synthetic peptide
WYPCWLAQVGELCDRE

SEQ ID NO: 819 - protein, 21 aa, Artificial Sequence
  Description of Artificial Sequence: Synthetic peptide
RGVYFPCWLAKVGDLCDSDEF

SEQ ID NO: 820 - protein, 22 aa, Artificial Sequence
  Description of Artificial Sequence: Synthetic peptide
RAWWWPCELAQVGELCDLEPSS

SEQ ID NO: 821 - protein, 16 aa, Artificial Sequence
  Description of Artificial Sequence: Synthetic peptide
WYPCWLAKVGELCDQE

SEQ ID NO: 822 - protein, 20 aa, Artificial Sequence
  Description of Artificial Sequence: Synthetic peptide
RYVPDCLKAQVGDLCDFFAW

SEQ ID NO: 823 - protein, 16 aa, Artificial Sequence
  Description of Artificial Sequence: Synthetic peptide
WWPCYLAQIGELCDLV

SEQ ID NO: 824 - protein, 16 aa, Artificial Sequence
  Description of Artificial Sequence: Synthetic peptide
WYPCWMAKVGELCDME

SEQ ID NO: 825 - protein, 22 aa, Artificial Sequence
  Description of Artificial Sequence: Synthetic peptide
QITDSGWYPCWVAKVGELCDMD

SEQ ID NO: 826 - protein, 22 aa, Artificial Sequence
  Description of Artificial Sequence: Synthetic peptide
YRWWYPCDIAQVGELCDLDYLL

SEQ ID NO: 827 - protein, 20 aa, Artificial Sequence
  Description of Artificial Sequence: Synthetic peptide
CYMHDCFMAQVGDLCDRFIS

SEQ ID NO: 828 - protein, 16 aa, Artificial Sequence
  Description of Artificial Sequence: Synthetic peptide
WLPCWIAKIGDLCDLD

SEQ ID NO: 829 - protein, 22 aa, Artificial Sequence
  Description of Artificial Sequence: Synthetic peptide
SRVWHPCWLARVGELCDLEVSD

SEQ ID NO: 830 - protein, 22 aa, Artificial Sequence
  Description of Artificial Sequence: Synthetic peptide
WEHEFTWYPCWIAQVGELCDMD

SEQ ID NO: 831 - protein, 22 aa, Artificial Sequence
  Description of Artificial Sequence: Synthetic peptide
HRGWVGWYPCEYALPGQLCDLE

SEQ ID NO: 832 - protein, 21 aa, Artificial Sequence
  Description of Artificial Sequence: Synthetic peptide
WYPCWLAQLGELCDQDWDTPS

SEQ ID NO: 833 - protein, 22 aa, Artificial Sequence
  Description of Artificial Sequence: Synthetic peptide
RVRRHSWWPCEIAVVGELCDLE

SEQ ID NO: 834 - protein, 21 aa, Artificial Sequence
  Description of Artificial Sequence: Synthetic peptide
DGWWPCWIAQVGELCDLEDPV

SEQ ID NO: 835 - protein, 20 aa, Artificial Sequence
  Description of Artificial Sequence: Synthetic peptide
LPFQDCYIAQVGELCDLPGT

SEQ ID NO: 836 - protein, 20 aa, Artificial Sequence
  Description of Artificial Sequence: Synthetic peptide
RWMFDCLFARVGELCDIRPW

SEQ ID NO: 837 - protein, 20 aa, Artificial Sequence
  Description of Artificial Sequence: Synthetic peptide
GGYYDCLIAEVGELCDMPGQ

SEQ ID NO: 838 - protein, 20 aa, Artificial Sequence
  Description of Artificial Sequence: Synthetic peptide
VVCYACDIAHVGELCDLTCR

SEQ ID NO: 839 - protein, 20 aa, Artificial Sequence
  Description of Artificial Sequence: Synthetic peptide
TPWYDCYIANVGDLCDFASA

SEQ ID NO: 840 - protein, 20 aa, Artificial Sequence
  Description of Artificial Sequence: Synthetic peptide
LESLDCFFARIGDLCEIWDV

SEQ ID NO: 841 - protein, 20 aa, Artificial Sequence
  Description of Artificial Sequence: Synthetic peptide
WQIFDCYLAQVGELCDLQDT

SEQ ID NO: 842 - protein, 20 aa, Artificial Sequence
  Description of Artificial Sequence: Synthetic peptide
GRYPDCYIAHVGELCEFYDG

SEQ ID NO: 843 - protein, 20 aa, Artificial Sequence
  Description of Artificial Sequence: Synthetic peptide
FGDDFCRFIPLFEMCTTDVE

SEQ ID NO: 844 - protein, 20 aa, Artificial Sequence
  Description of Artificial Sequence: Synthetic peptide
LVYYDCYMAQVGELCDLPSL

SEQ ID NO: 845 - protein, 20 aa, Artificial Sequence
  Description of Artificial Sequence: Synthetic peptide
VSRYDCYIAKVGELCDFFEF

SEQ ID NO: 846 - protein, 20 aa, Artificial Sequence
  Description of Artificial Sequence: Synthetic peptide
VTVQDCYFARVGDLCDLFSP

SEQ ID NO: 847 - protein, 20 aa, Artificial Sequence
  Description of Artificial Sequence: Synthetic peptide
WEWYDCLMAQVGELCDFEGN

SEQ ID NO: 848 - protein, 20 aa, Artificial Sequence
  Description of Artificial Sequence: Synthetic peptide
WAFYDCRNAQVGDFCDLWEF

SEQ ID NO: 849 - protein, 20 aa, Artificial Sequence
  Description of Artificial Sequence: Synthetic peptide
SMDQDCYFAQVGELCVLFNQ

SEQ ID NO: 850 - protein, 20 aa, Artificial Sequence
  Description of Artificial Sequence: Synthetic peptide
GGYYDCLIAEVGELCDIYGR

SEQ ID NO: 851 - protein, 20 aa, Artificial Sequence
  Description of Artificial Sequence: Synthetic peptide
SNWHDCLFAQVGELCDLPGS

SEQ ID NO: 852 - protein, 14 aa, Artificial Sequence
  Description of Artificial Sequence: Synthetic peptide
YDCYIAQVGELCDI

SEQ ID NO: 853 - protein, 20 aa, Artificial Sequence
  Description of Artificial Sequence: Synthetic peptide
SWLSDLQDCYIAQVGDLCQI

SEQ ID NO: 854 - protein, 20 aa, Artificial Sequence
  Description of Artificial Sequence: Synthetic peptide
  MOD_RES (17)..(17): Any amino acid
RGDIGYYDCYIAQVGEXCDV

SEQ ID NO: 855 - protein, 20 aa, Artificial Sequence
  Description of Artificial Sequence: Synthetic peptide
RLASDWWDCYIAKVGELCDF

SEQ ID NO: 856 - protein, 20 aa, Artificial Sequence
  Description of Artificial Sequence: Synthetic peptide
RLLRDCFLAKVGDLCELFVW

SEQ ID NO: 857 - protein, 20 aa, Artificial Sequence
  Description of Artificial Sequence: Synthetic peptide
QWFHNCFLARVGDTCDLFLW

SEQ ID NO: 858 - protein, 20 aa, Artificial Sequence
  Description of Artificial Sequence: Synthetic peptide
ELLVDCFKVKVGELCDLFFG

SEQ ID NO: 859 - protein, 20 aa, Artificial Sequence
  Description of Artificial Sequence: Synthetic peptide
RYVHDCFIAQVGDLCDLFLH

SEQ ID NO: 860 - protein, 20 aa, Artificial Sequence
  Description of Artificial Sequence: Synthetic peptide
KWVHDCFLAKVGDVCDLFVV

SEQ ID NO: 861 - protein, 20 aa, Artificial Sequence
  Description of Artificial Sequence: Synthetic peptide
RSLVDCFLVKVGDLCDFFNW

SEQ ID NO: 862 - protein, 20 aa, Artificial Sequence
  Description of Artificial Sequence: Synthetic peptide
RYLYDCFLALVGDLCVKFHQ

SEQ ID NO: 863 - protein, 20 aa, Artificial Sequence
  Description of Artificial Sequence: Synthetic peptide
AHFYDCFWAKAGELCDLWPS

SEQ ID NO: 864 - protein, 20 aa, Artificial Sequence
  Description of Artificial Sequence: Synthetic peptide
KWFHDCFLAKVGDLCDLFLW

SEQ ID NO: 865 - protein, 22 aa, Artificial Sequence
  Description of Artificial Sequence: Synthetic peptide
WGKLVRDCFLAKVGDLCDLFLW

SEQ ID NO: 866 - protein, 20 aa, Artificial Sequence
  Description of Artificial Sequence: Synthetic peptide
THVHDCFLAKVGDLCDLFIV

SEQ ID NO: 867 - protein, 20 aa, Artificial Sequence
  Description of Artificial Sequence: Synthetic peptide
HWVRDCFLAKVGELCDLFLW

SEQ ID NO: 868 - protein, 20 aa, Artificial Sequence
  Description of Artificial Sequence: Synthetic peptide
HGILDCYFAKVGELCELFDW

SEQ ID NO: 869 - protein, 20 aa, Artificial Sequence
  Description of Artificial Sequence: Synthetic peptide
QFVKDCFLAQVGDLCELFLW

SEQ ID NO: 870 - protein, 20 aa, Artificial Sequence
  Description of Artificial Sequence: Synthetic peptide
DWLPDCYFANVGDLCSLFGS

SEQ ID NO: 871 - protein, 20 aa, Artificial Sequence
  Description of Artificial Sequence: Synthetic peptide
HWFLDCFLANVGDLCDFFGN

SEQ ID NO: 872 - protein, 20 aa, Artificial Sequence
  Description of Artificial Sequence: Synthetic peptide
NWLPDCLFANVGELCDIFPW

SEQ ID NO: 873 - protein, 20 aa, Artificial Sequence
  Description of Artificial Sequence: Synthetic peptide
EIFKDCLFANVGELCEIFPS

SEQ ID NO: 874 - protein, 20 aa, Artificial Sequence
  Description of Artificial Sequence: Synthetic peptide
NWFHDCFLARVGDLCDLFLD

SEQ ID NO: 875 - protein, 20 aa, Artificial Sequence
  Description of Artificial Sequence: Synthetic peptide
YSFKDCYFAKVGELCELFLW

SEQ ID NO: 876 - protein, 20 aa, Artificial Sequence
  Description of Artificial Sequence: Synthetic peptide
EFFHDCYVARVGELCDLFGW

SEQ ID NO: 877 - protein, 16 aa, Artificial Sequence
  Description of Artificial Sequence: Synthetic peptide
SYLCWLDHWGVICEED

SEQ ID NO: 878 - protein, 16 aa, Artificial Sequence
  Description of Artificial Sequence: Synthetic peptide
WYTCMMDWLGVHCELE

SEQ ID NO: 879 - protein, 22 aa, Artificial Sequence
  Description of Artificial Sequence: Synthetic peptide
QMVWWDCWSTQEGPVCELNWTA

SEQ ID NO: 880 - protein, 20 aa, Artificial Sequence
  Description of Artificial Sequence: Synthetic peptide
YWCSVWQLGSVCEMNNEETQ

SEQ ID NO: 881 - protein, 22 aa, Artificial Sequence
  Description of Artificial Sequence: Synthetic peptide
WTCWLTQLGYDCNLDVVDQSLG

SEQ ID NO: 882 - protein, 22 aa, Artificial Sequence
  Description of Artificial Sequence: Synthetic peptide
DGSWYTCWFTQLGEWCEQDDAK

SEQ ID NO: 883 - protein, 22 aa, Artificial Sequence
  Description of Artificial Sequence: Synthetic peptide
EFWGWQCWQEPLGWSCDLEWMD

SEQ ID NO: 884 - protein, 16 aa, Artificial Sequence
  Description of Artificial Sequence: Synthetic peptide
WYPCWIARVGELCDLE

SEQ ID NO: 885 - protein, 16 aa, Artificial Sequence
  Description of Artificial Sequence: Synthetic peptide
WYPCWLAQVGELCDLD

SEQ ID NO: 886 - protein, 16 aa, Artificial Sequence
  Description of Artificial Sequence: Synthetic peptide
LVDCFKVKVGELCDLF

SEQ ID NO: 887 - protein, 16 aa, Artificial Sequence
  Description of Artificial Sequence: Synthetic peptide
VHDCFIAQVGDLCDLF

SEQ ID NO: 888 - protein, 14 aa, Artificial Sequence
  Description of Artificial Sequence: Synthetic peptide
WPCWAALGELCDLD

SEQ ID NO: 889 - protein, 13 aa, Artificial Sequence
  Description of Artificial Sequence: Synthetic peptide
WPCWALGELCDLD

SEQ ID NO: 890 - protein, 12 aa, Artificial Sequence
  Description of Artificial Sequence: Synthetic peptide
WPCWLGELCDLD

SEQ ID NO: 891 - protein, 12 aa, Artificial Sequence
  Description of Artificial Sequence: Synthetic peptide
WYPCWGELCDLD

SEQ ID NO: 892-899 - skipped (8 entries)

SEQ ID NO: 900 - protein, 20 aa, Artificial Sequence
  Description of Artificial Sequence: Synthetic peptide
  MOD_RES (1)..(1): A, D, E, H, K, N, Q, R, or T
  MOD_RES (2)..(2): F, G, H, I, L, S, W, or Y
  MOD_RES (3)..(3): F, I, L, or V
  MOD_RES (4)..(4): H, K, L, P, R, V, or Y
  MOD_RES (7)..(7): F, L, or Y
  MOD_RES (8)..(8): F, I, K, L, V, or W
  MOD_RES (9)..(9): A or V
  MOD_RES (10)..(10): K, L, N, Q, or R
  MOD_RES (11)..(11): A or V
  MOD_RES (13)..(13): D or E
  MOD_RES (14)..(14): L, T, or V
  MOD_RES (16)..(16): D, E, S, or V
  MOD_RES (17)..(17): F, I, K, or L
  MOD_RES (18)..(18): F or W
  MOD_RES (19)..(19): D, F, G, I, L, N, P, or V
  MOD_RES (20)..(20): D, G, H, N, Q, S, V, or W
XXXXDCXXXXXGXXCXXXXX

SEQ ID NO: 901 - protein, 18 aa, Artificial Sequence
  Description of Artificial Sequence: Synthetic peptide
  MOD_RES (1)..(1): F, G, H, I, L, S, W, or Y
  MOD_RES (2)..(2): F, I, L, or V
  MOD_RES (3)..(3): H, K, L, P, R, V, or Y
  MOD_RES (6)..(6): F, L, or Y
  MOD_RES (7)..(7): F, I, K, L, V, or W
  MOD_RES (8)..(8): A or V
  MOD_RES (9)..(9): K, L, N, Q, or R
  MOD_RES (10)..(10): A or V
  MOD_RES (12)..(12): D or E
  MOD_RES (13)..(13): L, T, or V
  MOD_RES (15)..(15): D, E, S, or V
  MOD_RES (16)..(16): F, I, K, or L
  MOD_RES (17)..(17): F or W
  MOD_RES (18)..(18): D, F, G, I, L, N, P, or V
XXXDCXXXXXGXXCXXXX

SEQ ID NO: 902 - protein, 16 aa, Artificial Sequence
  Description of Artificial Sequence: Synthetic peptide
  MOD_RES (1)..(1): F, I, L, or V
  MOD_RES (2)..(2): H, K, L, P, R, V, or Y
  MOD_RES (5)..(5): F, L, or Y
  MOD_RES (6)..(6): F, I, K, L, V, or W
  MOD_RES (7)..(7): A or V
  MOD_RES (8)..(8): K, L, N, Q, or R
  MOD_RES (9)..(9): A or V
  MOD_RES (11)..(11): D or E
  MOD_RES (12)..(12): L, T, or V
  MOD_RES (14)..(14): D, E, S, or V
  MOD_RES (15)..(15): F, I, K, or L
  MOD_RES (16)..(16): F or W
XXDCXXXXXGXXCXXX

SEQ ID NO: 903 - protein, 14 aa, Artificial Sequence
  Description of Artificial Sequence: Synthetic peptide
  MOD_RES (1)..(1): H, K, L, P, R, V, or Y
  MOD_RES (4)..(4): F, L, or Y
  MOD_RES (5)..(5): F, I, K, L, V, or W
  MOD_RES (6)..(6): A or V
  MOD_RES (7)..(7): K, L, N, Q, or R
  MOD_RES (8)..(8): A or V
  MOD_RES (10)..(10): D or E
  MOD_RES (11)..(11): L, T, or V
  MOD_RES (13)..(13): D, E, S, or V
  MOD_RES (14)..(14): F, I, K, or L
XDCXXXXXGXXCXX

SEQ ID NO: 904 - protein, 12 aa, Artificial Sequence
  Description of Artificial Sequence: Synthetic peptide
  MOD_RES (3)..(3): F, L, or Y
  MOD_RES (4)..(4): F, I, K, L, V, or W
  MOD_RES (5)..(5): A or V
  MOD_RES (6)..(6): K, L, N, Q, or R
  MOD_RES (7)..(7): A or V
  MOD_RES (9)..(9): D or E
  MOD_RES (10)..(10): L, T, or V
  MOD_RES (12)..(12): D, E, S, or V
DCXXXXXGXXCX

SEQ ID NO: 905 - protein, 10 aa, Artificial Sequence
  Description of Artificial Sequence: Synthetic peptide
  MOD_RES (2)..(2): F, L, or Y
  MOD_RES (3)..(3): F, I, K, L, V, or W
  MOD_RES (4)..(4): A or V
  MOD_RES (5)..(5): K, L, N, Q, or R
  MOD_RES (6)..(6): A or V
  MOD_RES (8)..(8): D or E
  MOD_RES (9)..(9): L, T, or V
CXXXXXGXXC

SEQ ID NO: 906 - protein, 8 aa, Artificial Sequence
  Description of Artificial Sequence: Synthetic peptide
  MOD_RES (1)..(1): F, L, or Y
  MOD_RES (2)..(2): F, I, K, L, V, or W
  MOD_RES (3)..(3): A or V
  MOD_RES (4)..(4): K, L, N, Q, or R
  MOD_RES (5)..(5): A or V
  MOD_RES (7)..(7): D or E
  MOD_RES (8)..(8): L, T, or V
XXXXXGXX

SEQ ID NO: 907 - protein, 20 aa, Artificial Sequence
  Description of Artificial Sequence: Synthetic peptide
AFFHDCFFAKAGDLCDFFDD

SEQ ID NO: 908 - protein, 20 aa, Artificial Sequence
  Description of Artificial Sequence: Synthetic peptide
DFFHDCFFAKVGDLCDFFFG

SEQ ID NO: 909 - protein, 20 aa, Artificial Sequence
  Description of Artificial Sequence: Synthetic peptide
EGFHDCFFAKVGDLCDIFGH

SEQ ID NO: 910 - protein, 20 aa, Artificial Sequence
  Description of Artificial Sequence: Synthetic peptide
EHFHDCFFAKVGDLCDIFGN

SEQ ID NO: 911 - protein, 20 aa, Artificial Sequence
  Description of Artificial Sequence: Synthetic peptide
EHFHDCFFAKVGDLCDKFGQ

SEQ ID NO: 912 - protein, 20 aa, Artificial Sequence
  Description of Artificial Sequence: Synthetic peptide
HIFHDCFIAKVGDLCDLFHS

SEQ ID NO: 913 - protein, 20 aa, Artificial Sequence
  Description of Artificial Sequence: Synthetic peptide
HLFHDCFKAKVGDLCDLFIS

SEQ ID NO: 914 - protein, 20 aa, Artificial Sequence
  Description of Artificial Sequence: Synthetic peptide
HLFKDCFLAKVGDLCDLFLS

SEQ ID NO: 915 - protein, 22 aa, Artificial Sequence
  Description of Artificial Sequence: Synthetic peptide
WGKSIKDCFLAKVGDLCDLFLV

SEQ ID NO: 916 - protein, 20 aa, Artificial Sequence
  Description of Artificial Sequence: Synthetic peptide
KSLKDCFLAKVGDLCDLFLV

SEQ ID NO: 917 - protein, 20 aa, Artificial Sequence
  Description of Artificial Sequence: Synthetic peptide
KWLLDCFLALVGDLCDLFLW

SEQ ID NO: 918 - protein, 20 aa, Artificial Sequence
  Description of Artificial Sequence: Synthetic peptide
NWLLDCFLANVGDLCDLFLW

SEQ ID NO: 919 - protein, 20 aa, Artificial Sequence
  Description of Artificial Sequence: Synthetic peptide
NWLPDCFLANVGELCDLFLW

SEQ ID NO: 920 - protein, 20 aa, Artificial Sequence
  Description of Artificial Sequence: Synthetic peptide
QWLPDCFLANVGELCDLFLW

SEQ ID NO: 921 - protein, 20 aa, Artificial Sequence
  Description of Artificial Sequence: Synthetic peptide
QWVRDCLLANVGELCELFLW

SEQ ID NO: 922 - protein, 20 aa, Artificial Sequence
  Description of Artificial Sequence: Synthetic peptide
RWVRDCLLAQVGELCELFNW

SEQ ID NO: 923 - protein, 20 aa, Artificial Sequence
  Description of Artificial Sequence: Synthetic peptide
RWVVDCYLAQVGELCELFPW

SEQ ID NO: 924 - protein, 20 aa, Artificial Sequence
  Description of Artificial Sequence: Synthetic peptide
RWVVDCYLARVGELCELFPW

SEQ ID NO: 925 - protein, 20 aa, Artificial Sequence
  Description of Artificial Sequence: Synthetic peptide
TYVYDCYVVRVGETCSLFPW

SEQ ID NO: 926 - protein, 20 aa, Artificial Sequence
  Description of Artificial Sequence: Synthetic peptide
YYVYNCYWVRVGEVCVLWVW

SEQ ID NO: 927-929 - skipped (3 entries)

SEQ ID NO: 930 - protein, 24 aa, Artificial Sequence
  Description of Artificial Sequence: Synthetic peptide
GGWYPCWIARVGELCDLEEGPVNR

SEQ ID NO: 931 - protein, 23 aa, Artificial Sequence
  Description of Artificial Sequence: Synthetic peptide
GGAVEFYPCWLARIGELCDLVEP

SEQ ID NO: 932 - protein, 18 aa, Artificial Sequence
  Description of Artificial Sequence: Synthetic peptide
GGWYPCWIARVGELCDME

SEQ ID NO: 933 - protein, 25 aa, Artificial Sequence
  Description of Artificial Sequence: Synthetic peptide
GGEWFHDCFLAKVGDLCDLFLGGEW

SEQ ID NO: 934 - protein, 22 aa, Artificial Sequence
  Description of Artificial Sequence: Synthetic peptide
GGRYVHDCFIAQVGDLCDLFLH

SEQ ID NO: 935 - protein, 22 aa, Artificial Sequence
  Description of Artificial Sequence: Synthetic peptide
GGRSLVDCFLVKVGDLCDFFNW

SEQ ID NO: 936 - protein, 18 aa, Artificial Sequence
  Description of Artificial Sequence: Synthetic peptide
GGWYPCWIARVGELCDLE

SEQ ID NO: 937 - protein, 18 aa, Artificial Sequence
  Description of Artificial Sequence: Synthetic peptide
GGWYPCWLAQVGELCDLD

SEQ ID NO: 938 - protein, 18 aa, Artificial Sequence
  Description of Artificial Sequence: Synthetic peptide
GGLVDCFKVKVGELCDLF

SEQ ID NO: 939 - protein, 18 aa, Artificial Sequence
  Description of Artificial Sequence: Synthetic peptide
GGWYSCWMAQLGELCDLD

SEQ ID NO: 940-1000 - skipped (61 entries)

SEQ ID NO: 1001 - protein, 8 aa, Artificial Sequence
  Description of Artificial Sequence: Synthetic peptide
  MOD_RES (1)..(1): Any amino acid comprising a polar-neutral side chain or an acidic side chain
  MOD_RES (2)..(2): Any amino acid comprising a polar-neutral side chain or an acidic side chain
  MOD_RES (3)..(3): Any amino acid
  MOD_RES (4)..(4): Any amino acid
  MOD_RES (5)..(5): Any amino acid comprising a small hydrophobic side chain
  MOD_RES (6)..(6): Any amino acid comprising a large hydrophobic side chain
  MOD_RES (7)..(7): Any amino acid comprising a large hydrophobic side chain
  MOD_RES (8)..(8): Any amino acid comprising a large hydrophobic side chain
XXXXXXXX

SEQ ID NO: 1002 - protein, 10 aa, Artificial Sequence
  Description of Artificial Sequence: Synthetic peptide
  MOD_RES (2)..(2): Any amino acid comprising a polar-neutral side chain or an acidic side chain
  MOD_RES (3)..(3): Any amino acid comprising a polar-neutral side chain or an acidic side chain
  MOD_RES (4)..(4): Any amino acid
  MOD_RES (5)..(5): Any amino acid
  MOD_RES (6)..(6): Any amino acid comprising a small hydrophobic side chain
  MOD_RES (7)..(7): Any amino acid comprising a large hydrophobic side chain
  MOD_RES (8)..(8): Any amino acid comprising a large hydrophobic side chain
  MOD_RES (9)..(9): Any amino acid comprising a large hydrophobic side chain
CXXXXXXXXC

SEQ ID NO: 1003 - protein, 12 aa, Artificial Sequence
  Description of Artificial Sequence: Synthetic peptide
  MOD_RES (1)..(1): Any amino acid
  MOD_RES (3)..(3): Any amino acid comprising a polar-neutral side chain or an acidic side chain
  MOD_RES (4)..(4): Any amino acid comprising a polar-neutral side chain or an acidic side chain
  MOD_RES (5)..(5): Any amino acid
  MOD_RES (6)..(6): Any amino acid
  MOD_RES (7)..(7): Any amino acid comprising a small hydrophobic side chain
  MOD_RES (8)..(8): Any amino acid comprising a large hydrophobic side chain
  MOD_RES (9)..(9): Any amino acid comprising a large hydrophobic side chain
  MOD_RES (10)..(10): Any amino acid comprising a large hydrophobic side chain
  MOD_RES (12)..(12): Any amino acid comprising a large hydrophobic side chain
XCXXXXXXXXCX

SEQ ID NO: 1004 - protein, 14 aa, Artificial Sequence
  Description of Artificial Sequence: Synthetic peptide
  MOD_RES (1)..(1): Any amino acid
  MOD_RES (2)..(2): Any amino acid
  MOD_RES (4)..(4): Any amino acid comprising a polar-neutral side chain or an acidic side chain
  MOD_RES (5)..(5): Any amino acid comprising a polar-neutral side chain or an acidic side chain
  MOD_RES (6)..(6): Any amino acid
  MOD_RES (7)..(7): Any amino acid
  MOD_RES (8)..(8): Any amino acid comprising a small hydrophobic side chain
  MOD_RES (9)..(9): Any amino acid comprising a large hydrophobic side chain
  MOD_RES (10)..(10): Any amino acid comprising a large hydrophobic side chain
  MOD_RES (11)..(11): Any amino acid comprising a large hydrophobic side chain
  MOD_RES (13)..(13): Any amino acid comprising a large hydrophobic side chain
  MOD_RES (14)..(14): Any amino acid
XXCXXXXXXXXCXX

SEQ ID NO: 1005 - protein, 14 aa, Artificial Sequence
  Description of Artificial Sequence: Synthetic peptide
GTCQEYNGVMICWG

SEQ ID NO: 1006 - protein, 14 aa, Artificial Sequence
  Description of Artificial Sequence: Synthetic peptide
IECNRDECPMICWA

SEQ ID NO: 1007 - protein, 14 aa, Artificial Sequence
  Description of Artificial Sequence: Synthetic peptide
IACSQEMGILLCWV

SEQ ID NO: 1008 - protein, 14 aa, Artificial Sequence
  Description of Artificial Sequence: Synthetic peptide
IHCNSQMGILICWY

SEQ ID NO: 1009 - protein, 14 aa, Artificial Sequence
  Description of Artificial Sequence: Synthetic peptide
IMCDSSSGVSICWT

SEQ ID NO: 1010 - protein, 14 aa, Artificial Sequence
  Description of Artificial Sequence: Synthetic peptide
ITCQTFNGVPLCWK

SEQ ID NO: 1011 - protein, 14 aa, Artificial Sequence
  Description of Artificial Sequence: Synthetic peptide
KVCEMWGGVLLCWN

SEQ ID NO: 1012 - protein, 14 aa, Artificial Sequence
  Description of Artificial Sequence: Synthetic peptide
KWCQDWFGVLLCTV

SEQ ID NO: 1013 - protein, 14 aa, Artificial Sequence
  Description of Artificial Sequence: Synthetic peptide
LECNNSYGVLLCWS

SEQ ID NO: 1014 - protein, 14 aa, Artificial Sequence
  Description of Artificial Sequence: Synthetic peptide
LTCQNWQGVSLCWN

SEQ ID NO: 1015 - protein, 14 aa, Artificial Sequence
  Description of Artificial Sequence: Synthetic peptide
LVCDDTLGVTLCWW

SEQ ID NO: 1016 - protein, 14 aa, Artificial Sequence
  Description of Artificial Sequence: Synthetic peptide
LECDASMSVMICWF

SEQ ID NO: 1017 - protein, 14 aa, Artificial Sequence
  Description of Artificial Sequence: Synthetic peptide
LDCDTSMGVPLCWF

SEQ ID NO: 1018 - protein, 14 aa, Artificial Sequence
  Description of Artificial Sequence: Synthetic peptide
QLCQIWQEVLLCWP

SEQ ID NO: 1019 - protein, 14 aa, Artificial Sequence
  Description of Artificial Sequence: Synthetic peptide
RICQDFQGVILCWL

SEQ ID NO: 1020 - protein, 14 aa, Artificial Sequence
  Description of Artificial Sequence: Synthetic peptide
RRCQDYLGILLCWE

SEQ ID NO: 1021 - protein, 14 aa, Artificial Sequence
  Description of Artificial Sequence: Synthetic peptide
RTCTEWENVVLCWV

SEQ ID NO: 1022 - protein, 14 aa, Artificial Sequence
  Description of Artificial Sequence: Synthetic peptide
RVCQDWLGVKLCWN

SEQ ID NO: 1023 - protein, 14 aa, Artificial Sequence
  Description of Artificial Sequence: Synthetic peptide
TSCFNFDGVLLCWQ

SEQ ID NO: 1024 - protein, 14 aa, Artificial Sequence
  Description of Artificial Sequence: Synthetic peptide
VSCESWQGTLFCWQ

SEQ ID NO: 1025 - protein, 14 aa, Artificial Sequence
  Description of Artificial Sequence: Synthetic peptide
VTCQDWNGVLLCFP

SEQ ID NO: 1026 - protein, 14 aa, Artificial Sequence
  Description of Artificial Sequence: Synthetic peptide
VSCDGSSGVLLCWM

SEQ ID NO: 1027 - protein, 14 aa, Artificial Sequence
  Description of Artificial Sequence: Synthetic peptide
VTCQTWNQVLLCWS

SEQ ID NO: 1028 - protein, 14 aa, Artificial Sequence
  Description of Artificial Sequence: Synthetic peptide
VMCEDWGGVPICWI

SEQ ID NO: 1029 - protein, 14 aa, Artificial Sequence
  Description of Artificial Sequence: Synthetic peptide
YLCDESMGVKLCWF

SEQ ID NO: 1030 - protein, 8 aa, Artificial Sequence
  Description of Artificial Sequence: Synthetic peptide
  MOD_RES (1)..(1): Any amino acid
  MOD_RES (2)..(2): Any amino acid
  MOD_RES (3)..(3): Any amino acid comprising a large hydrophobic side chain
  MOD_RES (4)..(4): Any amino acid
  MOD_RES (5)..(5): Any small hydrophobic side chain
  MOD_RES (6)..(6): Any amino acid comprising a large hydrophobic side chain
  MOD_RES (7)..(7): Any amino acid comprising a basic side chain, an acidic side chain, or a polar-neutral side chain
  MOD_RES (8)..(8): Any amino acid comprising a large hydrophobic side chain
XXXXXXXX

SEQ ID NO: 1031 - protein, 10 aa, Artificial Sequence
  Description of Artificial Sequence: Synthetic peptide
  MOD_RES (2)..(2): Any amino acid
  MOD_RES (3)..(3): Any amino acid
  MOD_RES (4)..(4): Any amino acid comprising a large hydrophobic side chain
  MOD_RES (5)..(5): Any amino acid
  MOD_RES (6)..(6): Any small hydrophobic side chain
  MOD_RES (7)..(7): Any amino acid comprising a large hydrophobic side chain
  MOD_RES (8)..(8): Any amino acid comprising a basic side chain, an acidic side chain, or a polar-neutral side chain
  MOD_RES (9)..(9): Any amino acid comprising a large hydrophobic side chain
CXXXXXXXXC

SEQ ID NO: 1032 - protein, 12 aa, Artificial Sequence
  Description of Artificial Sequence: Synthetic peptide
  MOD_RES (1)..(1): Any amino acid
  MOD_RES (3)..(3): Any amino acid
  MOD_RES (4)..(4): Any amino acid
  MOD_RES (5)..(5): Any amino acid comprising a large hydrophobic side chain
  MOD_RES (6)..(6): Any amino acid
  MOD_RES (7)..(7): Any small hydrophobic side chain
  MOD_RES (8)..(8): Any amino acid comprising a large hydrophobic side chain
  MOD_RES (9)..(9): Any amino acid comprising a basic side chain, an acidic side chain, or a polar-neutral side chain
  MOD_RES (10)..(10): Any amino acid comprising a large hydrophobic side chain
  MOD_RES (12)..(12): Any amino acid comprising a large hydrophobic side chain
XCXXXXXXXXCX

SEQ ID NO: 1033 - protein, 14 aa, Artificial Sequence
  Description of Artificial Sequence: Synthetic peptide
  MOD_RES (1)..(1): Any amino acid
  MOD_RES (2)..(2): Any amino acid
  MOD_RES (4)..(4): Any amino acid
  MOD_RES (5)..(5): Any amino acid
  MOD_RES (6)..(6): Any amino acid comprising a large hydrophobic side chain
  MOD_RES (7)..(7): Any amino acid
  MOD_RES (8)..(8): Any small hydrophobic side chain
  MOD_RES (9)..(9): Any amino acid comprising a large hydrophobic side chain
  MOD_RES (10)..(10): Any amino acid comprising a basic side chain, an acidic side chain, or a polar-neutral side chain
  MOD_RES (11)..(11): Any amino acid comprising a large hydrophobic side chain
  MOD_RES (13)..(13): Any amino acid comprising a large hydrophobic side chain
  MOD_RES (14)..(14): Any amino acid
XXCXXXXXXXXCXX

SEQ ID NO: 1034 - protein, 12 aa, Artificial Sequence
  Description of Artificial Sequence: Synthetic peptide
DCSMWEGVELCW

SEQ ID NO: 1035 - protein, 14 aa, Artificial Sequence
  Description of Artificial Sequence: Synthetic peptide
FTCWDYNGVDLCQI

SEQ ID NO: 1036 - protein, 15 aa, Artificial Sequence
  Description of Artificial Sequence: Synthetic peptide
FSCFILETLELACWP

SEQ ID NO: 1037 - protein, 14 aa, Artificial Sequence
  Description of Artificial Sequence: Synthetic peptide
FVCELWDGIELCIP

SEQ ID NO: 1038 - protein, 14 aa, Artificial Sequence
  Description of Artificial Sequence: Synthetic peptide
GACNPHTQQEDCFG

SEQ ID NO: 1039 - protein, 14 aa, Artificial Sequence
  Description of Artificial Sequence: Synthetic peptide
IECEFWDGMQLCWQ

SEQ ID NO: 1040 - protein, 14 aa, Artificial Sequence
  Description of Artificial Sequence: Synthetic peptide
ILCQDWSGIEICWS

SEQ ID NO: 1041 - protein, 14 aa, Artificial Sequence
  Description of Artificial Sequence: Synthetic peptide
IVCEEWSGVRFCWN

SEQ ID NO: 1042 - protein, 14 aa, Artificial Sequence
  Description of Artificial Sequence: Synthetic peptide
IECQVFHGLELCWI

SEQ ID NO: 1043 - protein, 14 aa, Artificial Sequence
  Description of Artificial Sequence: Synthetic peptide
LICYTYEGVELCWQ

SEQ ID NO: 1044 - protein, 14 aa, Artificial Sequence
  Description of Artificial Sequence: Synthetic peptide
LVCSMFNGVDLCWQ

SEQ ID NO: 1045 - protein, 14 aa, Artificial Sequence
  Description of Artificial Sequence: Synthetic peptide
LDCMDYNGVRLCWN

SEQ ID NO: 1046 - protein, 14 aa, Artificial Sequence
  Description of Artificial Sequence: Synthetic peptide
LTCVTYEGVDLCWQ

SEQ ID NO: 1047 - protein, 14 aa, Artificial Sequence
  Description of Artificial Sequence: Synthetic peptide
PRCEIWLGVELCRI

SEQ ID NO: 1048 - protein, 14 aa, Artificial Sequence
  Description of Artificial Sequence: Synthetic peptide
PACQDWNGVELCIL

SEQ ID NO: 1049 - protein, 14 aa, Artificial Sequence
  Description of Artificial Sequence: Synthetic peptide
QICQEWSGVNLCWH

SEQ ID NO: 1050 - protein, 14 aa, Artificial Sequence
  Description of Artificial Sequence: Synthetic peptide
QTCWDYEGMELCLI

SEQ ID NO: 1051 - protein, 14 aa, Artificial Sequence
  Description of Artificial Sequence: Synthetic peptide
QECTDWQGVELCLL

SEQ ID NO: 1052 - protein, 14 aa, Artificial Sequence
  Description of Artificial Sequence: Synthetic peptide
RICNDWNGVQLCWP

SEQ ID NO: 1053 - protein, 14 aa, Artificial Sequence
  Description of Artificial Sequence: Synthetic peptide
TECQVWNGVELCYI

SEQ ID NO: 1054 - protein, 14 aa, Artificial Sequence
  Description of Artificial Sequence: Synthetic peptide
VDCVIWEGVQLCTW

SEQ ID NO: 1055 - protein, 14 aa, Artificial Sequence
  Description of Artificial Sequence: Synthetic peptide
VVCTDYLGVQLCWT

SEQ ID NO: 1056 - protein, 14 aa, Artificial Sequence
  Description of Artificial Sequence: Synthetic peptide
VMCERWQGVELCWL

SEQ ID NO: 1057 - protein, 14 aa, Artificial Sequence
  Description of Artificial Sequence: Synthetic peptide
VVCQGWSGVDICWQ

SEQ ID NO: 1058 - protein, 14 aa, Artificial Sequence
  Description of Artificial Sequence: Synthetic peptide
VICQSYDGVEFCWF

SEQ ID NO: 1059 - protein, 14 aa, Artificial Sequence
  Description of Artificial Sequence: Synthetic peptide
VVCEMYSGVQICWA

SEQ ID NO: 1060 - protein, 14 aa, Artificial Sequence
  Description of Artificial Sequence: Synthetic peptide
VMCELFDEVELCWF

SEQ ID NO: 1061 - protein, 14 aa, Artificial Sequence
  Description of Artificial Sequence: Synthetic peptide
VECDVYHGVEICWA

SEQ ID NO: 1062 - protein, 9 aa, Artificial Sequence
  Description of Artificial Sequence: Synthetic peptide
  MOD_RES (1)..(1): Any amino acid comprising an acidic side chain or large hydrophobic side chain
  MOD_RES (2)..(2): Any amino acid
  MOD_RES (3)..(3): Any amino acid
  MOD_RES (4)..(4): Any amino acid
  MOD_RES (5)..(5): Any amino acid comprising a large hydrophobic side chain
  MOD_RES (6)..(6): Any amino acid comprising a small hydrophobic side chain or a large hydrophobic side chain
  MOD_RES (7)..(7): Any amino acid
  MOD_RES (8)..(8): Any amino acid comprising a large hydrophobic side chain
  MOD_RES (9)..(9): Any amino acid comprising a large hydrophobic side chain
XXXXXXXXX

SEQ ID NO: 1063 - protein, 11 aa, Artificial Sequence
  Description of Artificial Sequence: Synthetic peptide
  MOD_RES (1)..(1): Any amino acid
  MOD_RES (2)..(2): Any amino acid comprising an acidic side chain or large hydrophobic side chain
  MOD_RES (3)..(3): Any amino acid
  MOD_RES (4)..(4): Any amino acid
  MOD_RES (5)..(5): Any amino acid
  MOD_RES (6)..(6): Any amino acid comprising a large hydrophobic side chain
  MOD_RES (7)..(7): Any amino acid comprising a small hydrophobic side chain or a large hydrophobic side chain
  MOD_RES (8)..(8): Any amino acid
  MOD_RES (9)..(9): Any amino acid comprising a large hydrophobic side chain
  MOD_RES (10)..(10): Any amino acid comprising a large hydrophobic side chain
  MOD_RES (11)..(11): Any amino acid comprising a small hydrophobic side chain or an acidic side chain or cysteine
XXXXXXXXXXX

SEQ ID NO: 1064 - protein, 13 aa, Artificial Sequence
  Description of Artificial Sequence: Synthetic peptide
  MOD_RES (1)..(1): Any amino acid comprising an acidic side chain or cysteine
  MOD_RES (2)..(2): Any amino acid
  MOD_RES (3)..(3): Any amino acid comprising an acidic side chain or large hydrophobic side chain
  MOD_RES (4)..(4): Any amino acid
  MOD_RES (5)..(5): Any amino acid
  MOD_RES (6)..(6): Any amino acid
  MOD_RES (7)..(7): Any amino acid comprising a large hydrophobic side chain
  MOD_RES (8)..(8): Any amino acid comprising a small hydrophobic side chain or a large hydrophobic side chain
  MOD_RES (9)..(9): Any amino acid
  MOD_RES (10)..(10): Any amino acid comprising a large hydrophobic side chain
  MOD_RES (11)..(11): Any amino acid comprising a large hydrophobic side chain
  MOD_RES (12)..(12): Any amino acid comprising a small hydrophobic side chain or an acidic side chain or cysteine
  MOD_RES (13)..(13): Any amino acid comprising an acidic side chain or a hydroxyl-containing side chain or cysteine
XXXXXXXXXXXXX

SEQ ID NO: 1065 - protein, 14 aa, Artificial Sequence
  Description of Artificial Sequence: Synthetic peptide
CESFSEALGTWIDC

SEQ ID NO: 1066 - protein, 14 aa, Artificial Sequence
  Description of Artificial Sequence: Synthetic peptide
CVFLEDWWIWAGDC

SEQ ID NO: 1067 - protein, 14 aa, Artificial Sequence
  Description of Artificial Sequence: Synthetic peptide
DCPQVSWYEWLDCY

SEQ ID NO: 1068 - protein, 14 aa, Artificial Sequence
  Description of Artificial Sequence: Synthetic peptide
ECDAFGWIIWPHCL

SEQ ID NO: 1069 - protein, 14 aa, Artificial Sequence
  Description of Artificial Sequence: Synthetic peptide
FCWDSDKMLRWVCS

SEQ ID NO: 1070 - protein, 14 aa, Artificial Sequence
  Description of Artificial Sequence: Synthetic peptide
LCFSEFLGEWVDCN

SEQ ID NO: 1071 - protein, 14 aa, Artificial Sequence
  Description of Artificial Sequence: Synthetic peptide
MCWLEWGEWVGSCL

SEQ ID NO: 1072 - protein, 14 aa, Artificial Sequence
  Description of Artificial Sequence: Synthetic peptide
QCRRSDFEYVWLCT

SEQ ID NO: 1073 - protein, 14 aa, Artificial Sequence
  Description of Artificial Sequence: Synthetic peptide
VCSFDEAWGEWICE

SEQ ID NO: 1074 - protein, 14 aa, Artificial Sequence
  Description of Artificial Sequence: Synthetic peptide
YCLFDEQMGEWLCH

SEQ ID NO: 1075 - protein, 6 aa, Artificial Sequence
  Description of Artificial Sequence: Synthetic peptide
  MOD_RES (1)..(1): Any amino acid comprising an acidic side chain or a hydroxyl-containing side chain
  MOD_RES (2)..(2): Any amino acid
  MOD_RES (4)..(4): Any amino acid
  MOD_RES (5)..(5): Any amino acid comprising a large hydrophobic side chain
  MOD_RES (6)..(6): Any amino acid comprising a large hydrophobic side chain
XXCXXX

SEQ ID NO: 1076 - protein, 8 aa, Artificial Sequence
  Description of Artificial Sequence: Synthetic peptide
  MOD_RES (1)..(1): Any amino acid
  MOD_RES (2)..(2): Any amino acid comprising an acidic side chain or a hydroxyl-containing side chain
  MOD_RES (3)..(3): Any amino acid
  MOD_RES (5)..(5): Any amino acid
  MOD_RES (6)..(6): Any amino acid comprising a large hydrophobic side chain
  MOD_RES (7)..(7): Any amino acid comprising a large hydrophobic side chain
  MOD_RES (8)..(8): Any amino acid comprising a large hydrophobic side chain
XXXCXXXX

SEQ ID NO: 1077 - protein, 10 aa, Artificial Sequence
  Description of Artificial Sequence: Synthetic peptide
  MOD_RES (1)..(1): Any amino acid comprising a large hydrophobic side chain or an acidic side chain
  MOD_RES (2)..(2): Any amino acid
  MOD_RES (3)..(3): Any amino acid comprising an acidic side chain or a hydroxyl-containing side chain
  MOD_RES (4)..(4): Any amino acid
  MOD_RES (6)..(6): Any amino acid
  MOD_RES (7)..(7): Any amino acid comprising a large hydrophobic side chain
  MOD_RES (8)..(8): Any amino acid comprising a large hydrophobic side chain
  MOD_RES (9)..(9): Any amino acid comprising a large hydrophobic side chain
  MOD_RES (10)..(10): Any amino acid
XXXXCXXXXX

SEQ ID NO: 1078 - protein, 12 aa, Artificial Sequence
  Description of Artificial Sequence: Synthetic peptide
  MOD_RES (1)..(1): Any amino acid
  MOD_RES (2)..(2): Any amino acid comprising a large hydrophobic side chain or an acidic side chain
  MOD_RES (3)..(3): Any amino acid
  MOD_RES (4)..(4): Any amino acid comprising an acidic side chain or a hydroxyl-containing side chain
  MOD_RES (5)..(5): Any amino acid
  MOD_RES (7)..(7): Any amino acid
  MOD_RES (8)..(8): Any amino acid comprising a large hydrophobic side chain
  MOD_RES (9)..(9): Any amino acid comprising a large hydrophobic side chain
  MOD_RES (10)..(10): Any amino acid comprising a large hydrophobic side chain
  MOD_RES (11)..(11): Any amino acid
  MOD_RES (12)..(12): Any amino acid
XXXXXCXXXXXX

SEQ ID NO: 1079 - protein, 12 aa, Artificial Sequence
  Description of Artificial Sequence: Synthetic peptide
DLSDLCTFWLSQ

SEQ ID NO: 1080 - protein, 12 aa, Artificial Sequence
  Description of Artificial Sequence: Synthetic peptide
GLQELCSFYIAQ

SEQ ID NO: 1081 - protein, 12 aa, Artificial Sequence
  Description of Artificial Sequence: Synthetic peptide
IDMYPQEWWFCN

SEQ ID NO: 1082 - protein, 12 aa, Artificial Sequence
  Description of Artificial Sequence: Synthetic peptide
LSLGQKDWWLIL

SEQ ID NO: 1083 - protein, 12 aa, Artificial Sequence
  Description of Artificial Sequence: Synthetic peptide
QIRQLCEFWLSQ

SEQ ID NO: 1084 - protein, 12 aa, Artificial Sequence
  Description of Artificial Sequence: Synthetic peptide
QLGTLCDFFREN

SEQ ID NO: 1085 - protein, 12 aa, Artificial Sequence
  Description of Artificial Sequence: Synthetic peptide
QLQGLCDFFWAH

SEQ ID NO: 1086 - protein, 12 aa, Artificial Sequence
  Description of Artificial Sequence: Synthetic peptide
WCLSQEEFNFLV

SEQ ID NO: 1087 - protein, 12 aa, Artificial Sequence
  Description of Artificial Sequence: Synthetic peptide
YSEELSWICKQL

SEQ ID NO: 1088 - protein, 14 aa, Artificial Sequence
  Description of Artificial Sequence: Synthetic peptide
CPLSLMGSERIFVC

SEQ ID NO: 1089 - protein, 14 aa, Artificial Sequence
  Description of Artificial Sequence: Synthetic peptide
CTYFGPDAFRMLFC

SEQ ID NO: 1090 - protein, 14 aa, Artificial Sequence
  Description of Artificial Sequence: Synthetic peptide
CYFNSIFLGESPFC

SEQ ID NO: 1091 - protein, 14 aa, Artificial Sequence
  Description of Artificial Sequence: Synthetic peptide
CYLIYKNNQLALQC

SEQ ID NO: 1092 - protein, 14 aa, Artificial Sequence
  Description of Artificial Sequence: Synthetic peptide
CYVVYNYQEFRYLC

SEQ ID NO: 1093 - protein, 14 aa, Artificial Sequence
  Description of Artificial Sequence: Synthetic peptide
CDCQHHRCRTGGLV

SEQ ID NO: 1094 - protein, 14 aa, Artificial Sequence
  Description of Artificial Sequence: Synthetic peptide
CDLWPLTAQNFYGC

SEQ ID NO: 1095 - protein, 14 aa, Artificial Sequence
  Description of Artificial Sequence: Synthetic peptide
CPGELRGPERAWVC

SEQ ID NO: 1096 - protein, 15 aa, Artificial Sequence
  Description of Artificial Sequence: Synthetic peptide
ECGGAWAMLLWPHCT

SEQ ID NO: 1097 - protein, 15 aa, Artificial Sequence
  Description of Artificial Sequence: Synthetic peptide
ICTRLHDVVPIWSCP

SEQ ID NO: 1098 - protein, 14 aa, Artificial Sequence
  Description of Artificial Sequence: Synthetic peptide
LYCRDNDGTQYCET

SEQ ID NO: 1099 - protein, 14 aa, Artificial Sequence
  Description of Artificial Sequence: Synthetic peptide
LECATSEEPYYCYL

SEQ ID NO: 1100 - protein, 15 aa, Artificial Sequence
  Description of Artificial Sequence: Synthetic peptide
LFNFCQGDKTCMQWH

SEQ ID NO: 1101 - protein, 15 aa, Artificial Sequence
  Description of Artificial Sequence: Synthetic peptide
LFNFCQGDKTCMQWH

SEQ ID NO: 1102 - protein, 15 aa, Artificial Sequence
  Description of Artificial Sequence: Synthetic peptide
QCYRPSRDIPLYLCS

SEQ ID NO: 1103 - protein, 14 aa, Artificial Sequence
  Description of Artificial Sequence: Synthetic peptide
VCWLTHNRQSYYCD

SEQ ID NO: 1104 - protein, 14 aa, Artificial Sequence
  Description of Artificial Sequence: Synthetic peptide
YYCYLNIWTMKCED

SEQ ID NO: 1105 - protein, 14 aa, Artificial Sequence
  Description of Artificial Sequence: Synthetic peptide
YYCYLNIWPVKCED

SEQ ID NO: 1106 - protein, 14 aa, Artificial Sequence
  Description of Artificial Sequence: Synthetic peptide
  MOD_RES (2)..(2): Any amino acid comprising a large hydrophobic side chain
  MOD_RES (3)..(3): Any amino acid comprising a large hydrophobic side chain
  MOD_RES (4)..(4): Any amino acid comprising a large hydrophobic side chain
  MOD_RES (5)..(5): Any amino acid comprising a large hydrophobic side chain or an aromatic side chain
  MOD_RES (6)..(6): Any amino acid comprising a basic side chain or an acidic or polar neutral side chain
  MOD_RES (7)..(7): Any amino acid
  MOD_RES (8)..(8): Any amino acid comprising a small hydrophobic side chain
  MOD_RES (9)..(9): Any amino acid comprising an acidic or a polar neutral side chain
  MOD_RES (10)..(10): Any amino acid comprising a large hydrophobic side chain or an aromatic side chain
  MOD_RES (11)..(11): Any amino acid comprising a small hydrophobic side chain or a hydroxyl-containing side chain
  MOD_RES (12)..(12): Any amino acid comprising a large hydrophobic side chain or an aromatic side chain
  MOD_RES (13)..(13): Any amino acid comprising a large hydrophobic side chain
CXXXXXXXXXXXXC

SEQ ID NO: 1107 - protein, 12 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a large hydrophobic side chain
  MOD_RES (3)..(3): Any amino acid comprising a large hydrophobic side chain
  MOD_RES (4)..(4): Any amino acid comprising a large hydrophobic side chain or an aromatic side chain
  MOD_RES (5)..(5): Any amino acid comprising a basic side chain or an acidic or polar neutral side chain
  MOD_RES (6)..(6): Any amino acid
  MOD_RES (7)..(7): Any amino acid comprising a small hydrophobic side chain
  MOD_RES (8)..(8): Any amino acid comprising an acidic or a polar neutral side chain
  MOD_RES (9)..(9): Any amino acid comprising a large hydrophobic side chain or an aromatic side chain
  MOD_RES (10)..(10): Any amino acid comprising a small hydrophobic side chain or a hydroxyl-containing side chain
  MOD_RES (11)..(11): Any amino acid comprising a large hydrophobic side chain or an aromatic side chain
  MOD_RES (12)..(12): Any amino acid comprising a large hydrophobic side chain
XXXXXXXXXXXX

SEQ ID NO: 1108 - protein, 14 aa, Artificial Sequence
  Description of Artificial Sequence: Synthetic peptide
CGIAYRSGEFTMIC

SEQ ID NO: 1109 - protein, 14 aa, Artificial Sequence
  Description of Artificial Sequence: Synthetic peptide
CPSMLQGPERTWVC

SEQ ID NO: 1110 - protein, 14 aa, Artificial Sequence
  Description of Artificial Sequence: Synthetic peptide
CANLHDTQEWWYYC

SEQ ID NO: 1111 - protein, 14 aa, Artificial Sequence
  Description of Artificial Sequence: Synthetic peptide
CELLTGIPEYNFLC

SEQ ID NO: 1112 - protein, 14 aa, Artificial Sequence
  Description of Artificial Sequence: Synthetic peptide
CFIRFYQDKYDYVC

SEQ ID NO: 1113 - protein, 14 aa, Artificial Sequence
  Description of Artificial Sequence: Synthetic peptide
CFIRYLRGEFSFVC

SEQ ID NO: 1114 - protein, 14 aa, Artificial Sequence
  Description of Artificial Sequence: Synthetic peptide
CFLRFIHGELDYYC

SEQ ID NO: 1115 - protein, 14 aa, Artificial Sequence
  Description of Artificial Sequence: Synthetic peptide
CFVMYKNNEFSLIC

SEQ ID NO: 1116 - protein, 14 aa, Artificial Sequence
  Description of Artificial Sequence: Synthetic peptide
CGIAYRSGEFTMIC

SEQ ID NO: 1117 - protein, 14 aa, Artificial Sequence
  Description of Artificial Sequence: Synthetic peptide
CLIYKEQKFALIEC

SEQ ID NO: 1118 - protein, 14 aa, Artificial Sequence
  Description of Artificial Sequence: Synthetic peptide
CYIIYRLGTFSYMC

SEQ ID NO: 1119 - protein, 14 aa, Artificial Sequence
  Description of Artificial Sequence: Synthetic peptide
WCIYYPFTDVEACT

SEQ ID NO: 1120 - protein, 5 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a small hydrophobic side chain or a hydroxyl-containing side chain
  MOD_RES (3)..(3): Any amino acid comprising a small hydrophobic side chain
  MOD_RES (4)..(4): Any amino acid comprising a small hydrophobic side chain or a hydroxyl-containing side chain
  MOD_RES (5)..(5): Any amino acid comprising a small hydrophobic side chain or a hydroxyl-containing side chain
XXXXX

SEQ ID NO: 1121 - protein, 7 aa, Artificial Sequence
  Description of Artificial Sequence: Synthetic peptide
  MOD_RES (2)..(2): Any amino acid comprising a large hydrophobic side chain
  MOD_RES (3)..(3): Any amino acid comprising a small hydrophobic side chain or a hydroxyl-containing side chain
  MOD_RES (4)..(4): Any amino acid comprising a small hydrophobic side chain
  MOD_RES (5)..(5): Any amino acid comprising a small hydrophobic side chain or a hydroxyl-containing side chain
  MOD_RES (6)..(6): Any amino acid comprising a small hydrophobic side chain or a hydroxyl-containing side chain
CXXXXXC

SEQ ID NO: 1122 - protein, 9 aa, Artificial Sequence
  Description of Artificial Sequence: Synthetic peptide
  MOD_RES (1)..(1): Any amino acid comprising a basic side chain
  MOD_RES (3)..(3): Any amino acid comprising a large hydrophobic side chain
  MOD_RES (4)..(4): Any amino acid comprising a small hydrophobic side chain or a hydroxyl-containing side chain
  MOD_RES (5)..(5): Any amino acid comprising a small hydrophobic side chain
  MOD_RES (6)..(6): Any amino acid comprising a small hydrophobic side chain or a hydroxyl-containing side chain
  MOD_RES (7)..(7): Any amino acid comprising a small hydrophobic side chain or a hydroxyl-containing side chain
  MOD_RES (9)..(9): Any amino acid comprising a small hydrophobic side chain or a hydroxyl-containing side chain
XCXXXXXCX

SEQ ID NO: 1123 - protein, 11 aa, Artificial Sequence
  Description of Artificial Sequence: Synthetic peptide
  MOD_RES (1)..(1): Any amino acid comprising an acidic or polar neutral side chain
  MOD_RES (2)..(2): Any amino acid comprising a basic side chain
  MOD_RES (4)..(4): Any amino acid comprising a large hydrophobic side chain
  MOD_RES (5)..(5): Any amino acid comprising a small hydrophobic side chain or a hydroxyl-containing side chain
  MOD_RES (6)..(6): Any amino acid comprising a small hydrophobic side chain
  MOD_RES (7)..(7): Any amino acid comprising a small hydrophobic side chain or a hydroxyl-containing side chain
  MOD_RES (8)..(8): Any amino acid comprising a small hydrophobic side chain or a hydroxyl-containing side chain
  MOD_RES (10)..(10): Any amino acid comprising a small hydrophobic side chain or a hydroxyl-containing side chain
  MOD_RES (11)..(11): Any amino acid
XXCXXXXXCXX

SEQ ID NO: 1124 - protein, 15 aa, Artificial Sequence
  Description of Artificial Sequence: Synthetic peptide
  MOD_RES (1)..(1): Any amino acid comprising a small hydrophobic side chain or a hydroxyl-containing side chain
  MOD_RES (2)..(2): Any amino acid comprising a large hydrophobic side chain
  MOD_RES (3)..(3): Any amino acid comprising an acidic or polar neutral side chain
  MOD_RES (4)..(4): Any amino acid comprising a basic side chain
  MOD_RES (6)..(6): Any amino acid comprising a large hydrophobic side chain
  MOD_RES (7)..(7): Any amino acid comprising a small hydrophobic side chain or a hydroxyl-containing side chain
  MOD_RES (8)..(8): Any amino acid comprising a small hydrophobic side chain
  MOD_RES (9)..(9): Any amino acid comprising a small hydrophobic side chain or a hydroxyl-containing side chain
  MOD_RES (10)..(10): Any amino acid comprising a small hydrophobic side chain or a hydroxyl-containing side chain
  MOD_RES (12)..(12): Any amino acid comprising a small hydrophobic side chain or a hydroxyl-containing side chain
  MOD_RES (13)..(13): Any amino acid
  MOD_RES (14)..(14): Any amino acid comprising a large hydrophobic side chain or a basic side chain
  MOD_RES (15)..(15): Any amino acid comprising a large hydrophobic side chain
XXXXCXXXXXCXXXX

SEQ ID NO: 1125 - protein, 15 aa, Artificial Sequence
  Description of Artificial Sequence: Synthetic peptide
KMNKCATPSQCSVIF

SEQ ID NO: 1126 - protein, 15 aa, Artificial Sequence
  Description of Artificial Sequence: Synthetic peptide
NLNKCWNPRSCSSKF

SEQ ID NO: 1127 - protein, 15 aa, Artificial Sequence
  Description of Artificial Sequence: Synthetic peptide
SLYKCNSPLSCSNIF

SEQ ID NO: 1128 - protein, 15 aa, Artificial Sequence
  Description of Artificial Sequence: Synthetic peptide
SLLKCYNASTCASVF

SEQ ID NO: 1129 - protein, 15 aa, Artificial Sequence
  Description of Artificial Sequence: Synthetic peptide
TYNKCRSPFECSGIF

SEQ ID NO: 1130 - protein, 15 aa, Artificial Sequence
  Description of Artificial Sequence: Synthetic peptide
YLNKCYSPSSCQLRL

SEQ ID NO: 1131 - protein, 20 aa, Artificial Sequence
  Description of Artificial Sequence: Synthetic peptide
  MOD_RES (1)..(1): Any amino acid comprising a basic side chain
  MOD_RES (2)..(2): Any amino acid comprising a hydroxyl-containing side chain
  MOD_RES (3)..(3): Any amino acid comprising an acidic side chain or a large hydrophobic side chain
  MOD_RES (4)..(4): Any amino acid comprising a large hydrophobic side chain
  MOD_RES (5)..(5): Any amino acid comprising an acidic side chain or a large hydrophobic side chain
  MOD_RES (7)..(7): Any amino acid comprising an acidic side chain or a polar/neutral side chain
  MOD_RES (8)..(8): Any amino acid comprising an acidic side chain
  MOD_RES (9)..(9): Any amino acid comprising a large hydrophobic side chain or an aromatic side chain
  MOD_RES (10)..(10): Any amino acid comprising an acidic side chain or a polar/neutral side chain
  MOD_RES (17)..(17): Any amino acid comprising a large hydrophobic side chain
  MOD_RES (19)..(19): Any amino acid
  MOD_RES (20)..(20): Any amino acid comprising an acidic side chain
XXXXXCXXXXGVELCWXEXX

SEQ ID NO: 1132 - protein, 18 aa, Artificial Sequence
  Description of Artificial Sequence: Synthetic peptide
  MOD_RES (1)..(1): Any amino acid comprising a hydroxyl-containing side chain
  MOD_RES (2)..(2): Any amino acid comprising an acidic side chain or a large hydrophobic side chain
  MOD_RES (3)..(3): Any amino acid comprising a large hydrophobic side chain
  MOD_RES (4)..(4): Any amino acid comprising an acidic side chain or a large hydrophobic side chain
  MOD_RES (6)..(6): Any amino acid comprising an acidic side chain or a polar/neutral side chain
  MOD_RES (7)..(7): Any amino acid comprising an acidic side chain
  MOD_RES (8)..(8): Any amino acid comprising a large hydrophobic side chain or an aromatic side chain
  MOD_RES (9)..(9): Any amino acid comprising an acidic side chain or a polar/neutral side chain
  MOD_RES (16)..(16): Any amino acid comprising a large hydrophobic side chain
  MOD_RES (18)..(18): Any amino acid
XXXXCXXXXGVELCWXEX

SEQ ID NO: 1133 - protein, 16 aa, Artificial Sequence
  Description of Artificial Sequence: Synthetic peptide
  MOD_RES (1)..(1): Any amino acid comprising an acidic side chain or a large hydrophobic side chain
  MOD_RES (2)..(2): Any amino acid comprising a large hydrophobic side chain
  MOD_RES (3)..(3): Any amino acid comprising an acidic side chain or a large hydrophobic side chain
  MOD_RES (5)..(5): Any amino acid comprising an acidic side chain or a polar/neutral side chain
  MOD_RES (6)..(6): Any amino acid comprising an acidic side chain
  MOD_RES (7)..(7): Any amino acid comprising a large hydrophobic side chain or an aromatic side chain
  MOD_RES (8)..(8): Any amino acid comprising an acidic side chain or a polar/neutral side chain
  MOD_RES (15)..(15): Any amino acid comprising a large hydrophobic side chain
XXXCXXXXGVELCWXE

SEQ ID NO: 1134 - protein, 14 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising an acidic side chain or a large hydrophobic side chain
  MOD_RES (4)..(4): Any amino acid comprising an acidic side chain or a polar/neutral side chain
  MOD_RES (5)..(5): Any amino acid comprising an acidic side chain
  MOD_RES (6)..(6): Any amino acid comprising a large hydrophobic side chain or an aromatic side chain
  MOD_RES (7)..(7): Any amino acid comprising an acidic side chain or a polar/neutral side chain
  MOD_RES (14)..(14): Any amino acid comprising a large hydrophobic side chain
XXCXXXXGVELCWX

SEQ ID NO: 1135 - protein, 12 aa, Artificial Sequence
  Description of Artificial Sequence: Synthetic peptide
  MOD_RES (1)..(1): Any amino acid comprising an acidic side chain or a large hydrophobic side chain
  MOD_RES (3)..(3): Any amino acid comprising an acidic side chain or a polar/neutral side chain
  MOD_RES (4)..(4): Any amino acid comprising an acidic side chain
  MOD_RES (5)..(5): Any amino acid comprising a large hydrophobic side chain or an aromatic side chain
  MOD_RES (6)..(6): Any amino acid comprising an acidic side chain or a polar/neutral side chain
XCXXXXGVELCW

SEQ ID NO: 1136 - protein, 10 aa, Artificial Sequence
  Description of Artificial Sequence: Synthetic peptide
  MOD_RES (2)..(2): Any amino acid comprising an acidic side chain or a polar/neutral side chain
  MOD_RES (3)..(3): Any amino acid comprising an acidic side chain
  MOD_RES (4)..(4): Any amino acid comprising a large hydrophobic side chain or an aromatic side chain
  MOD_RES (5)..(5): Any amino acid comprising an acidic side chain or a polar/neutral side chain
CXXXXGVELC

SEQ ID NO: 1137 - protein, 20 aa, Artificial Sequence
  Description of Artificial Sequence: Synthetic peptide
AHSRQEVVCEEWYGVELCWI

SEQ ID NO: 1138 - protein, 20 aa, Artificial Sequence
  Description of Artificial Sequence: Synthetic peptide
ANQNTVVECQDWHGVELCWQ

SEQ ID NO: 1139 - protein, 20 aa, Artificial Sequence
  Description of Artificial Sequence: Synthetic peptide
AVCQDWYGVELCWCMQDILD

SEQ ID NO: 1140 - protein, 15 aa, Artificial Sequence
  Description of Artificial Sequence: Synthetic peptide
DVECVDWGGVELCWH

SEQ ID NO: 1141 - protein, 20 aa, Artificial Sequence
  Description of Artificial Sequence: Synthetic peptide
DFERSYVVCQDWDGVELCWI

SEQ ID NO: 1142 - protein, 15 aa, Artificial Sequence
  Description of Artificial Sequence: Synthetic peptide
DVVCQNWEGVDLCWH

SEQ ID NO: 1143 - protein, 20 aa, Artificial Sequence
  Description of Artificial Sequence: Synthetic peptide
DWRRSVVECQDWYGVELCWQ

SEQ ID NO: 1144 - protein, 15 aa, Artificial Sequence
  Description of Artificial Sequence: Synthetic peptide
DVVCQNWDGVDLCWH

SEQ ID NO: 1145 - protein, 20 aa, Artificial Sequence
  Description of Artificial Sequence: Synthetic peptide
DRQVVCEEWDGVELCWIEES

SEQ ID NO: 1146 - protein, 20 aa, Artificial Sequence
  Description of Artificial Sequence: Synthetic peptide
ERPRSFIECQEWEGVELCWL

SEQ ID NO: 1147 - protein, 20 aa, Artificial Sequence
  Description of Artificial Sequence: Synthetic peptide
EGSTTTIECEEWAGVELCWL

SEQ ID NO: 1148 - protein, 20 aa, Artificial Sequence
  Description of Artificial Sequence: Synthetic peptide
EQQVVCQEWNGVELCWIEAG

SEQ ID NO: 1149 - protein, 20 aa, Artificial Sequence
  Description of Artificial Sequence: Synthetic peptide
FAHHGVVECQEWYGVELCWQ

SEQ ID NO: 1150 - protein, 20 aa, Artificial Sequence
  Description of Artificial Sequence: Synthetic peptide
GQGREVVVCHDWYGVELCWQ

SEQ ID NO: 1151 - protein, 20 aa, Artificial Sequence
  Description of Artificial Sequence: Synthetic peptide
GDRPKEVVCEDWKGVELCWI

SEQ ID NO: 1152 - protein, 20 aa, Artificial Sequence
  Description of Artificial Sequence: Synthetic peptide
GNDDSYIVCEEWKGVELCWI

SEQ ID NO: 1153 - protein, 20 aa, Artificial Sequence
  Description of Artificial Sequence: Synthetic peptide
GLEIACEDWYGVELCWLRRA

SEQ ID NO: 1154 - protein, 24 aa, Artificial Sequence
  Description of Artificial Sequence: Synthetic peptide
GYGVLCQEWQGVELCWPVQREAGV

SEQ ID NO: 1155 - protein, 20 aa, Artificial Sequence
  Description of Artificial Sequence: Synthetic peptide
GPEVVCEEFNRVELCWVEYN

SEQ ID NO: 1156 - protein, 20 aa, Artificial Sequence
  Description of Artificial Sequence: Synthetic peptide
GYGVVCEDFRGVELCWLERK

SEQ ID NO: 1157 - protein, 20 aa, Artificial Sequence
  Description of Artificial Sequence: Synthetic peptide
HEAREVVVCQDWYGVELCWQ

SEQ ID NO: 1158 - protein, 20 aa, Artificial Sequence
  Description of Artificial Sequence: Synthetic peptide
HSTVICQDWDGVELCWIEND

SEQ ID NO: 1159 - protein, 14 aa, Artificial Sequence
  Description of Artificial Sequence: Synthetic peptide
IECDTSYGVYICWQ

SEQ ID NO: 1160 - protein, 14 aa, Artificial Sequence
  Description of Artificial Sequence: Synthetic peptide
IECEEWRGVELCWQ

SEQ ID NO: 1161 - protein, 20 aa, Artificial Sequence
  Description of Artificial Sequence: Synthetic peptide
IWGRTVVECQDWEGVELCWQ

SEQ ID NO: 1162 - protein, 14 aa, Artificial Sequence
  Description of Artificial Sequence: Synthetic peptide
IVCEEWRGVELCWL

SEQ ID NO: 1163 - protein, 14 aa, Artificial Sequence
  Description of Artificial Sequence: Synthetic peptide
IVCEDWRGVELCWI

SEQ ID NO: 1164 - protein, 14 aa, Artificial Sequence
  Description of Artificial Sequence: Synthetic peptide
IECEEWAGVELCWL

SEQ ID NO: 1165 - protein, 20 aa, Artificial Sequence
  Description of Artificial Sequence: Synthetic peptide
ILCQEFEGVELCWLEESLAE

SEQ ID NO: 1166 - protein, 20 aa, Artificial Sequence
  Description of Artificial Sequence: Synthetic peptide
IMCQEWDGVELCWLERDKAN

SEQ ID NO: 1167 - protein, 20 aa, Artificial Sequence
  Description of Artificial Sequence: Synthetic peptide
INCQTWNGVELCWVDEGLYQ

SEQ ID NO: 1168 - protein, 20 aa, Artificial Sequence
  Description of Artificial Sequence: Synthetic peptide
IVCEEYNGVELCWVETSVKP

SEQ ID NO: 1169 - protein, 19 aa, Artificial Sequence
  Description of Artificial Sequence: Synthetic peptide
ILCEEWQGVELCWLEGGGS

SEQ ID NO: 1170 - protein, 20 aa, Artificial Sequence
  Description of Artificial Sequence: Synthetic peptide
KSQVECQDWEGVELCWVVSE

SEQ ID NO: 1171 - protein, 20 aa, Artificial Sequence
  Description of Artificial Sequence: Synthetic peptide
KITVECQDWDGVELCWPTWI

SEQ ID NO: 1172 - protein, 20 aa, Artificial Sequence
  Description of Artificial Sequence: Synthetic peptide
KLTVECQDWDGVELCWVGVE

SEQ ID NO: 1173 - protein, 20 aa, Artificial Sequence
  Description of Artificial Sequence: Synthetic peptide
KTTVACQDWGGVELCWVERV

SEQ ID NO: 1174 - protein, 20 aa, Artificial Sequence
  Description of Artificial Sequence: Synthetic peptide
KPVVVCEEWQGVELCWLEIQ

SEQ ID NO: 1175 - protein, 20 aa, Artificial Sequence
  Description of Artificial Sequence: Synthetic peptide
KYIVECQEWGGVELCWPEMV

SEQ ID NO: 1176 - protein, 20 aa, Artificial Sequence
  Description of Artificial Sequence: Synthetic peptide
KKIVVCQDWGGVELCWTEDD

SEQ ID NO: 1177 - protein, 20 aa, Artificial Sequence
  Description of Artificial Sequence: Synthetic peptide
LALRKEVVCQEYYGVELCWI

SEQ ID NO: 1178 - protein, 20 aa, Artificial Sequence
  Description of Artificial Sequence: Synthetic peptide
LNRSVWIECEEYEGVELCWL

SEQ ID NO: 1179 - protein, 20 aa, Artificial Sequence
  Description of Artificial Sequence: Synthetic peptide
MVNREVVVCEDWYGVELCWQ

SEQ ID NO: 1180 - protein, 20 aa, Artificial Sequence
  Description of Artificial Sequence: Synthetic peptide
PEGREVVVCRDWYGVELCWQ

SEQ ID NO: 1181 - protein, 20 aa, Artificial Sequence
  Description of Artificial Sequence: Synthetic peptide
PYGVVCQDWAGVELCWVENR

SEQ ID NO: 1182 - protein, 20 aa, Artificial Sequence
  Description of Artificial Sequence: Synthetic peptide
PVEVRCQEWEGVELCWVVGI

SEQ ID NO: 1183 - protein, 20 aa, Artificial Sequence
  Description of Artificial Sequence: Synthetic peptide
QLGVECQNWRGVELCWVSEI

SEQ ID NO: 1184 - protein, 20 aa, Artificial Sequence
  Description of Artificial Sequence: Synthetic peptide
RLLNSVVECLDWEGVELCWQ

SEQ ID NO: 1185 - protein, 20 aa, Artificial Sequence
  Description of Artificial Sequence: Synthetic peptide
RSDDEVVVCQEWEGVELCWQ

SEQ ID NO: 1186 - protein, 20 aa, Artificial Sequence
  Description of Artificial Sequence: Synthetic peptide
RSNQTVVECQDWEGVELCWQ

SEQ ID NO: 1187 - protein, 20 aa, Artificial Sequence
  Description of Artificial Sequence: Synthetic peptide
RPQIECQEWQGVELCWTREE

SEQ ID NO: 1188 - protein, 20 aa, Artificial Sequence
  Description of Artificial Sequence: Synthetic peptide
RVQVECEDWNGVELCWPVRV

SEQ ID NO: 1189 - protein, 20 aa, Artificial Sequence
  Description of Artificial Sequence: Synthetic peptide
RPEVVCQEWEGVELCWISPL

SEQ ID NO: 1190 - protein, 20 aa, Artificial Sequence
  Description of Artificial Sequence: Synthetic peptide
RLGVECQEWEGVDLCWISAF

SEQ ID NO: 1191 - protein, 20 aa, Artificial Sequence
  Description of Artificial Sequence: Synthetic peptide
RWAVSCQDWQGIELCWPEWD

SEQ ID NO: 1192 - protein, 20 aa, Artificial Sequence
  Description of Artificial Sequence: Synthetic peptide
RTGVECQDWHGVELCWPVWE

SEQ ID NO: 1193 - protein, 17 aa, Artificial Sequence
  Description of Artificial Sequence: Synthetic peptide
RTEVECEDWEGVELCWL

SEQ ID NO: 1194 - protein, 20 aa, Artificial Sequence
  Description of Artificial Sequence: Synthetic peptide
SAPERWVECEDWQGVELCWV

SEQ ID NO: 1195 - protein, 20 aa, Artificial Sequence
  Description of Artificial Sequence: Synthetic peptide
SAGRQEVVCQDWNGVELCWI

SEQ ID NO: 1196 - protein, 20 aa, Artificial Sequence
  Description of Artificial Sequence: Synthetic peptide
SPSIVCEEWAGVELCWVDYS

SEQ ID NO: 1197 - protein, 20 aa, Artificial Sequence
  Description of Artificial Sequence: Synthetic peptide
SVEVVCEEWHGVELCWPVFI

SEQ ID NO: 1198 - protein, 20 aa, Artificial Sequence
  Description of Artificial Sequence: Synthetic peptide
TANQTVVECQVWGGVELCWQ

SEQ ID NO: 1199 - protein, 20 aa, Artificial Sequence
  Description of Artificial Sequence: Synthetic peptide
TLGRTVVECQDWGGVELCWQ

SEQ ID NO: 1200 - protein, 20 aa, Artificial Sequence
  Description of Artificial Sequence: Synthetic peptide
TWNMSELECQDWNGVEICWH

SEQ ID NO: 1201 - protein, 20 aa, Artificial Sequence
  Description of Artificial Sequence: Synthetic peptide
TDEVSCQEWEGVELCWIERQ

SEQ ID NO: 1202 - protein, 20 aa, Artificial Sequence
  Description of Artificial Sequence: Synthetic peptide
TAEVVCQEWDGVELCWIEVL

SEQ ID NO: 1203 - protein, 14 aa, Artificial Sequence
  Description of Artificial Sequence: Synthetic peptide
VECQEWGGVELCWC

SEQ ID NO: 1204 - protein, 14 aa, Artificial Sequence
  Description of Artificial Sequence: Synthetic peptide
VVCQDWEGVELCWQ

SEQ ID NO: 1205 - protein, 14 aa, Artificial Sequence
  Description of Artificial Sequence: Synthetic peptide
VVCQEWEGVELCWC

SEQ ID NO: 1206 - protein, 20 aa, Artificial Sequence
  Description of Artificial Sequence: Synthetic peptide
VVCQEWEGVELCWYAGECMQ

SEQ ID NO: 1207 - protein, 20 aa, Artificial Sequence
  Description of Artificial Sequence: Synthetic peptide
VSCQEWDGVELCWVDGDLAA

SEQ ID NO: 1208 - protein, 20 aa, Artificial Sequence
  Description of Artificial Sequence: Synthetic peptide
VVCQEWEGVELCWVEPPLLP

SEQ ID NO: 1209 - protein, 20 aa, Artificial Sequence
  Description of Artificial Sequence: Synthetic peptide
VVCEVFQGVELCWCENEEFT

SEQ ID NO: 1210 - protein, 20 aa, Artificial Sequence
  Description of Artificial Sequence: Synthetic peptide
VTCQEYEGVELCWTVGCAYS

SEQ ID NO: 1211 - protein, 21 aa, Artificial Sequence
  Description of Artificial Sequence: Synthetic peptide
VVCQEWEGVELCWQTGPGAHA

SEQ ID NO: 1212 - protein, 20 aa, Artificial Sequence
  Description of Artificial Sequence: Synthetic peptide
VECEEWGGVELCWLADEVMW

SEQ ID NO: 1213 - protein, 16 aa, Artificial Sequence
  Description of Artificial Sequence: Synthetic peptide
VGIECEEWAGVELCWL

SEQ ID NO: 1214 - protein, 20 aa, Artificial Sequence
  Description of Artificial Sequence: Synthetic peptide
WSKKAEVVCEEWGGVEFCWI

SEQ ID NO: 1215 - protein, 20 aa, Artificial Sequence
  Description of Artificial Sequence: Synthetic peptide
YSRELYVQCEDWEGVELCWI

SEQ ID NO: 1216-1600 - skipped (385 entries)

SEQ ID NO: 1601 - protein, 16 aa, Artificial Sequence
  Description of Artificial Sequence: Synthetic peptide
GGDCSMWEGVELCWGG

SEQ ID NO: 1602 - protein, 18 aa, Artificial Sequence
  Description of Artificial Sequence: Synthetic peptide
GGVMCERWQGVELCWLGG

SEQ ID NO: 1603 - protein, 20 aa, Artificial Sequence
  Description of Artificial Sequence: Synthetic peptide
GGVGIECEEWAGVELCWLGG

SEQ ID NO: 1604 - protein, 24 aa, Artificial Sequence
  Description of Artificial Sequence: Synthetic peptide
GGTWNMSELECQDWNGVEICWHGG

SEQ ID NO: 1605 - protein, 21 aa, Artificial Sequence
  Description of Artificial Sequence: Synthetic peptide
GGRTEVECEDWEGVELCWLGG

SEQ ID NO: 1606 - protein, 24 aa, Artificial Sequence
  Description of Artificial Sequence: Synthetic peptide
GGRTGVECQDWHGVELCWPVWEGG

SEQ ID NO: 1607 - protein, 18 aa, Artificial Sequence
  Description of Artificial Sequence: Synthetic peptide
  MOD_RES (12)..(12): Abu
GGVVCQDWEGVXLCWQGG

SEQ ID NO: 1608 - protein, 18 aa, Artificial Sequence
  Description of Artificial Sequence: Synthetic peptide
  MOD_RES (12)..(12): Alb
GGVVCQDWEGVXLCWQGG

SEQ ID NO: 1609 - protein, 19 aa, Artificial Sequence
  Description of Artificial Sequence: Synthetic peptide
GGVVCQDWEGVDALCWQGG

SEQ ID NO: 1610 - protein, 18 aa, Artificial Sequence
  Description of Artificial Sequence: Synthetic peptide
GGVVCQDWEGVSLCWQGG

SEQ ID NO: 1611 - protein, 18 aa, Artificial Sequence
  Description of Artificial Sequence: Synthetic peptide
GGVVCQDWEGVGLCWQGG

SEQ ID NO: 1612 - protein, 19 aa, Artificial Sequence
  Description of Artificial Sequence: Synthetic peptide
GGVVCQDWEGVELCWQPPA

SEQ ID NO: 1613 - protein, 20 aa, Artificial Sequence
  Description of Artificial Sequence: Synthetic peptide
GGVVCQDWEGVELCWQGPPA

SEQ ID NO: 1614-2000 - skipped (387 entries)

SEQ ID NO: 2001 - protein, 14 aa, Artificial Sequence
  Description of Artificial Sequence: Synthetic peptide
  MOD_RES (1)..(1): Any amino acid comprising a small hydrophobic side chain
  MOD_RES (3)..(3): Any amino acid comprising a polar/neutral side chain or any amino acid comprising a large hydrophobic side chain
  MOD_RES (4)..(4): Any amino acid comprising a large hydrophobic side chain
  MOD_RES (5)..(5): Any amino acid comprising a large hydrophobic side chain
  MOD_RES (6)..(6): Any amino acid comprising an acidic side chain
  MOD_RES (7)..(7): Any amino acid comprising a large hydrophobic side chain
  MOD_RES (8)..(8): Any amino acid comprising an acidic side chain
  MOD_RES (9)..(9): Any amino acid comprising a small hydrophobic side chain
  MOD_RES (10)..(10): Any amino acid comprising a large hydrophobic side chain
  MOD_RES (11)..(11): Any amino acid comprising a large hydrophobic side chain
  MOD_RES (12)..(12): Any amino acid comprising a small hydrophobic side chain or any amino acid comprising a large hydrophobic side chain
  MOD_RES (14)..(14): Any amino acid
XCXXXXXXXXXXCX

SEQ ID NO: 2002 - protein, 12 aa, Artificial Sequence
  Description of Artificial Sequence: Synthetic peptide
  MOD_RES (2)..(2): Any amino acid comprising a polar/neutral side chain or any amino acid comprising a large hydrophobic side chain
  MOD_RES (3)..(3): Any amino acid comprising a large hydrophobic side chain
  MOD_RES (4)..(4): Any amino acid comprising a large hydrophobic side chain
  MOD_RES (5)..(5): Any amino acid comprising an acidic side chain
  MOD_RES (6)..(6): Any amino acid comprising a large hydrophobic side chain
  MOD_RES (7)..(7): Any amino acid comprising an acidic side chain
  MOD_RES (8)..(8): Any amino acid comprising a small hydrophobic side chain
  MOD_RES (9)..(9): Any amino acid comprising a large hydrophobic side chain
  MOD_RES (10)..(10): Any amino acid comprising a large hydrophobic side chain
  MOD_RES (11)..(11): Any amino acid comprising a small hydrophobic side chain or any amino acid comprising a large hydrophobic side chain
CXXXXXXXXXXC

SEQ ID NO: 2003 - protein, 10 aa, Artificial Sequence
  Description of Artificial Sequence: Synthetic peptide
  MOD_RES (1)..(1): Any amino acid comprising a polar/neutral side chain or any amino acid comprising a large hydrophobic side chain
  MOD_RES (2)..(2): Any amino acid comprising a large hydrophobic side chain
  MOD_RES (3)..(3): Any amino acid comprising a large hydrophobic side chain
  MOD_RES (4)..(4): Any amino acid comprising an acidic side chain
  MOD_RES (5)..(5): Any amino acid comprising a large hydrophobic side chain
  MOD_RES (6)..(6): Any amino acid comprising an acidic side chain
  MOD_RES (7)..(7): Any amino acid comprising a small hydrophobic side chain
  MOD_RES (8)..(8): Any amino acid comprising a large hydrophobic side chain
  MOD_RES (9)..(9): Any amino acid comprising a large hydrophobic side chain
  MOD_RES (10)..(10): Any amino acid comprising a small hydrophobic side chain or any amino acid comprising a large hydrophobic side chain
XXXXXXXXXX

SEQ ID NO: 2004 - protein, 14 aa, Artificial Sequence
  Description of Artificial Sequence: Synthetic peptide
PCFVYPEEDLLVCR

SEQ ID NO: 2005 - protein, 14 aa, Artificial Sequence
  Description of Artificial Sequence: Synthetic peptide
QCIHWDIETLLSCV

SEQ ID NO: 2006 - protein, 14 aa, Artificial Sequence
  Description of Artificial Sequence: Synthetic peptide
SCSHWDVESLAVCT

SEQ ID NO: 2007 - protein, 14 aa, Artificial Sequence
  Description of Artificial Sequence: Synthetic peptide
TCQHQDLQGLLACI

SEQ ID NO: 2008 - protein, 14 aa, Artificial Sequence
  Description of Artificial Sequence: Synthetic peptide
YCPHHDLDTLMSCA

SEQ ID NO: 2009 - protein, 16 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising an acidic side chain, any amino acid comprising a small hydrophobic side chain, or any amino acid comprising a large hydrophobic side chain
  MOD_RES (3)..(3): Any amino acid comprising a large hydrophobic side chain
  MOD_RES (5)..(5): Any amino acid
  MOD_RES (6)..(6): Any amino acid comprising an acidic side chain or any amino acid comprising a large hydrophobic side chain
  MOD_RES (7)..(7): Any amino acid comprising an acidic side chain or any amino acid comprising a large hydrophobic side chain
  MOD_RES (10)..(10): Any amino acid comprising a small hydrophobic side chain or any amino acid comprising a large hydrophobic side chain
  MOD_RES (11)..(11): Any amino acid comprising a small hydrophobic side chain or any amino acid comprising a large hydrophobic side chain
  MOD_RES (12)..(12): Any amino acid comprising an acidic side chain, any amino acid comprising a polar/neutral side chain, or any amino acid comprising a large hydrophobic side chain
  MOD_RES (14)..(14): Any amino acid
  MOD_RES (15)..(15): Any amino acid comprising a polar/neutral side chain or any amino acid comprising an aromatic side chain
  MOD_RES (16)..(16): Any amino acid comprising a polar/neutral side chain or any amino acid comprising a large hydrophobic side chain
XXXCXXXPGXXXCXXX

SEQ ID NO: 2010 - protein, 14 aa, Artificial Sequence
  Description of Artificial Sequence: Synthetic peptide
  MOD_RES (1)..(1): Any amino acid comprising an acidic side chain, any amino acid comprising a small hydrophobic side chain, or any amino acid comprising a large hydrophobic side chain
  MOD_RES (2)..(2): Any amino acid comprising a large hydrophobic side chain
  MOD_RES (4)..(4): Any amino acid
  MOD_RES (5)..(5): Any amino acid comprising an acidic side chain or any amino acid comprising a large hydrophobic side chain
  MOD_RES (6)..(6): Any amino acid comprising an acidic side chain or any amino acid comprising a large hydrophobic side chain
  MOD_RES (9)..(9): Any amino acid comprising a small hydrophobic side chain or any amino acid comprising a large hydrophobic side chain
  MOD_RES (10)..(10): Any amino acid comprising a small hydrophobic side chain or any amino acid comprising a large hydrophobic side chain
  MOD_RES (11)..(11): Any amino acid comprising an acidic side chain, any amino acid comprising a polar/neutral side chain, or any amino acid comprising a large hydrophobic side chain
  MOD_RES (13)..(13): Any amino acid
  MOD_RES (14)..(14): Any amino acid comprising a polar/neutral side chain or any amino acid comprising an aromatic side chain
XXCXXXPGXXXCXX

SEQ ID NO: 2011 - protein, 12 aa, Artificial Sequence
  Description of Artificial Sequence: Synthetic peptide
  MOD_RES (1)..(1): Any amino acid comprising a large hydrophobic side chain
  MOD_RES (3)..(3): Any amino acid
  MOD_RES (4)..(4): Any amino acid comprising an acidic side chain or any amino acid comprising a large hydrophobic side chain
  MOD_RES (5)..(5): Any amino acid comprising an acidic side chain or any amino acid comprising a large hydrophobic side chain
  MOD_RES (8)..(8): Any amino acid comprising a small hydrophobic side chain or any amino acid comprising a large hydrophobic side chain
  MOD_RES (9)..(9): Any amino acid comprising a small hydrophobic side chain or any amino acid comprising a large hydrophobic side chain
  MOD_RES (10)..(10): Any amino acid comprising an acidic side chain, any amino acid comprising a polar/neutral side chain, or any amino acid comprising a large hydrophobic side chain
  MOD_RES (12)..(12): Any amino acid
XCXXXPGXXXCX

SEQ ID NO: 2012 - protein, 10 aa, Artificial Sequence
  Description of Artificial Sequence: Synthetic peptide
  MOD_RES (2)..(2): Any amino acid
  MOD_RES (3)..(3): Any amino acid comprising an acidic side chain or any amino acid comprising a large hydrophobic side chain
  MOD_RES (4)..(4): Any amino acid comprising an acidic side chain or any amino acid comprising a large hydrophobic side chain
  MOD_RES (7)..(7): Any amino acid comprising a small hydrophobic side chain or any amino acid comprising a large hydrophobic side chain
  MOD_RES (8)..(8): Any amino acid comprising a small hydrophobic side chain or any amino acid comprising a large hydrophobic side chain
  MOD_RES (9)..(9): Any amino acid comprising an acidic side chain, any amino acid comprising a polar/neutral side chain, or any amino acid comprising a large hydrophobic side chain
CXXXPGXXXC

SEQ ID NO: 2013 - protein, 8 aa, Artificial Sequence
  Description of Artificial Sequence: Synthetic peptide
  MOD_RES (1)..(1): Any amino acid
  MOD_RES (2)..(2): Any amino acid comprising an acidic side chain or any amino acid comprising a large hydrophobic side chain
  MOD_RES (3)..(3): Any amino acid comprising an acidic side chain or any amino acid comprising a large hydrophobic side chain
  MOD_RES (6)..(6): Any amino acid comprising a small hydrophobic side chain or any amino acid comprising a large hydrophobic side chain
  MOD_RES (7)..(7): Any amino acid comprising a small hydrophobic side chain or any amino acid comprising a large hydrophobic side chain
  MOD_RES (8)..(8): Any amino acid comprising an acidic side chain, any amino acid comprising a polar/neutral side chain, or any amino acid comprising a large hydrophobic side chain
XXXPGXXX

SEQ ID NO: 2014 - protein, 16 aa, Artificial Sequence
  Description of Artificial Sequence: Synthetic peptide
DWLCRTDPGYLDCVSF

SEQ ID NO: 2015 - protein, 16 aa, Artificial Sequence
  Description of Artificial Sequence: Synthetic peptide
DWLCRPGPGLLVCQWF

SEQ ID NO: 2016 - protein, 16 aa, Artificial Sequence
  Description of Artificial Sequence: Synthetic peptide
IPWCTLWPGGPECQTL

SEQ ID NO: 2017 - protein, 16 aa, Artificial Sequence
  Description of Artificial Sequence: Synthetic peptide
RYECADLPGGLHCEFR

SEQ ID NO: 2018 - protein, 16 aa, Artificial Sequence
  Description of Artificial Sequence: Synthetic peptide
SYACDMNPGWDFCSDT

SEQ ID NO: 2019 - protein, 16 aa, Artificial Sequence
  Description of Artificial Sequence: Synthetic peptide
VPWCSLDPGSVQCVHS

SEQ ID NO: 2020 - protein, 16 aa, Artificial Sequence
  Description of Artificial Sequence: Synthetic peptide
VDWCDLAPGDFRCAWM

SEQ ID NO: 2021 - protein, 16 aa, Artificial Sequence
  Description of Artificial Sequence: Synthetic peptide
VPWCTLDPGSTQCAVI

SEQ ID NO: 2022 - protein, 15 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a large hydrophobic side chain
  MOD_RES (3)..(3): Any amino acid comprising a small hydrophobic side chain or any amino acid comprising a large hydrophobic side chain
  MOD_RES (5)..(5): Any amino acid comprising an acidic side chain, any amino acid comprising a hydroxyl side chain, or any amino acid comprising a large hydrophobic side chain
  MOD_RES (6)..(6): Any amino acid comprising a large hydrophobic side chain
  MOD_RES (7)..(7): Any amino acid comprising a small hydrophobic side chain, any amino acid comprising an acidic side chain, any amino acid comprising a polar/neutral side chain, or any amino acid comprising a basic side chain
  MOD_RES (8)..(8): Any amino acid comprising a small hydrophobic side chain or any amino acid comprising a polar/neutral side chain
  MOD_RES (9)..(9): Any amino acid comprising polar/neutral side chain or any amino acid comprising a large hydrophobic side chain
  MOD_RES (10)..(10): Any amino acid comprising a basic side chain
  MOD_RES (11)..(11): Any amino acid comprising a large hydrophobic side chain
  MOD_RES (12)..(12): Any amino acid comprising a basic side chain
  MOD_RES (14)..(14): Any amino acid comprising a small hydrophobic side chain
  MOD_RES (15)..(15): Any amino acid comprising a polar/neutral side chain or any amino acid comprising a large hydrophobic side chain
XXXCXXXXXXXXCXX

SEQ ID NO: 2023 - protein, 14 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a small hydrophobic side chain or any amino acid comprising a large hydrophobic side chain
  MOD_RES (4)..(4): Any amino acid comprising an acidic side chain, any amino acid comprising a hydroxyl side chain, or any amino acid comprising a large hydrophobic side chain
  MOD_RES (5)..(5): Any amino acid comprising a large hydrophobic side chain
  MOD_RES (6)..(6): Any amino acid comprising a small hydrophobic side chain, any amino acid comprising an acidic side chain, any amino acid comprising a polar/neutral side chain, or any amino acid comprising a basic side chain
  MOD_RES (7)..(7): Any amino acid comprising a small hydrophobic side chain or any amino acid comprising a polar/neutral side chain
  MOD_RES (8)..(8): Any amino acid comprising polar/neutral side chain or any amino acid comprising a large hydrophobic side chain
  MOD_RES (9)..(9): Any amino acid comprising a basic side chain
  MOD_RES (10)..(10): Any amino acid comprising a large hydrophobic side chain
  MOD_RES (11)..(11): Any amino acid comprising a basic side chain
  MOD_RES (13)..(13): Any amino acid comprising a small hydrophobic side chain
  MOD_RES (14)..(14): Any amino acid comprising a polar/neutral side chain or any amino acid comprising a large hydrophobic side chain
XXCXXXXXXXXCXX

SEQ ID NO: 2024 - protein, 12 aa, Artificial Sequence
  Description of Artificial Sequence: Synthetic peptide
  MOD_RES (1)..(1): Any amino acid comprising a small hydrophobic side chain or any amino acid comprising a large hydrophobic side chain
  MOD_RES (3)..(3): Any amino acid comprising an acidic side chain, any amino acid comprising a hydroxyl side chain, or any amino acid comprising a large hydrophobic side chain
  MOD_RES (4)..(4): Any amino acid comprising a large hydrophobic side chain
  MOD_RES (5)..(5): Any amino acid comprising a small hydrophobic side chain, any amino acid comprising an acidic side chain, any amino acid comprising a polar/neutral side chain, or any amino acid comprising a basic side chain
  MOD_RES (6)..(6): Any amino acid comprising a small hydrophobic side chain or any amino acid comprising a polar/neutral side chain
  MOD_RES (7)..(7): Any amino acid comprising polar/neutral side chain or any amino acid comprising a large hydrophobic side chain
  MOD_RES (8)..(8): Any amino acid comprising a basic side chain
  MOD_RES (9)..(9): Any amino acid comprising a large hydrophobic side chain
  MOD_RES (10)..(10): Any amino acid comprising a basic side chain
  MOD_RES (12)..(12): Any amino acid comprising a small hydrophobic side chain
XCXXXXXXXXCX

SEQ ID NO: 2025 - protein, 10 aa, Artificial Sequence
  Description of Artificial Sequence: Synthetic peptide
  MOD_RES (2)..(2): Any amino acid comprising an acidic side chain, any amino acid comprising a hydroxyl side chain, or any amino acid comprising a large hydrophobic side chain
  MOD_RES (3)..(3): Any amino acid comprising a large hydrophobic side chain
  MOD_RES (4)..(4): Any amino acid comprising a small hydrophobic side chain, any amino acid comprising an acidic side chain, any amino acid comprising a polar/neutral side chain, or any amino acid comprising a basic side chain
  MOD_RES (5)..(5): Any amino acid comprising a small hydrophobic side chain or any amino acid comprising a polar/neutral side chain
  MOD_RES (6)..(6): Any amino acid comprising polar/neutral side chain or any amino acid comprising a large hydrophobic side chain
  MOD_RES (7)..(7): Any amino acid comprising a basic side chain
  MOD_RES (8)..(8): Any amino acid comprising a large hydrophobic side chain
  MOD_RES (9)..(9): Any amino acid comprising a basic side chain
CXXXXXXXXC

SEQ ID NO: 2026 - protein, 8 aa, Artificial Sequence
  Description of Artificial Sequence: Synthetic peptide
  MOD_RES (1)..(1): Any amino acid comprising an acidic side chain, any amino acid comprising a hydroxyl side chain, or any amino acid comprising a large hydrophobic side chain
  MOD_RES (2)..(2): Any amino acid comprising a large hydrophobic side chain
  MOD_RES (3)..(3): Any amino acid comprising a small hydrophobic side chain, any amino acid comprising an acidic side chain, any amino acid comprising a polar/neutral side chain, or any amino acid comprising a basic side chain
  MOD_RES (4)..(4): Any amino acid comprising a small hydrophobic side chain or any amino acid comprising a polar/neutral side chain
  MOD_RES (5)..(5): Any amino acid comprising polar/neutral side chain or any amino acid comprising a large hydrophobic side chain
  MOD_RES (6)..(6): Any amino acid comprising a basic side chain
  MOD_RES (7)..(7): Any amino acid comprising a large hydrophobic side chain
  MOD_RES (8)..(8): Any amino acid comprising a basic side chain
XXXXXXXX

SEQ ID NO: 2027 - protein, 14 aa, Artificial Sequence
  Description of Artificial Sequence: Synthetic peptide
FWCEVFAGIKVCRP

SEQ ID NO: 2028 - protein, 14 aa, Artificial Sequence
  Description of Artificial Sequence: Synthetic peptide
IFCAIFHGVKVCRS

SEQ ID NO: 2029 - protein, 14 aa, Artificial Sequence
  Description of Artificial Sequence: Synthetic peptide
IYCQIFDTVKICRS

SEQ ID NO: 2030 - protein, 14 aa, Artificial Sequence
  Description of Artificial Sequence: Synthetic peptide
IYCMEFLSGRVCRG

SEQ ID NO: 2031 - protein, 14 aa, Artificial Sequence
  Description of Artificial Sequence: Synthetic peptide
IACANFHGTRVCRT

SEQ ID NO: 2032 - protein, 14 aa, Artificial Sequence
  Description of Artificial Sequence: Synthetic peptide
IYCAFLSGYKTCRS

SEQ ID NO: 2033 - protein, 14 aa, Artificial Sequence
  Description of Artificial Sequence: Synthetic peptide
IDCFDFGFTKVCRP

SEQ ID NO: 2034 - protein, 14 aa, Artificial Sequence
  Description of Artificial Sequence: Synthetic peptide
IYCAYLHGYKVCRK

SEQ ID NO: 2035 - protein, 14 aa, Artificial Sequence
  Description of Artificial Sequence: Synthetic peptide
IYCISISNHKVCRA

SEQ ID NO: 2036 - protein, 14 aa, Artificial Sequence
  Description of Artificial Sequence: Synthetic peptide
LYCMVFPAGKVCRS

SEQ ID NO: 2037 - protein, 14 aa, Artificial Sequence
  Description of Artificial Sequence: Synthetic peptide
LQCVVIRNQKLCRG

SEQ ID NO: 2038 - protein, 14 aa, Artificial Sequence
  Description of Artificial Sequence: Synthetic peptide
LECVTIKGYKLCRL

SEQ ID NO: 2039 - protein, 14 aa, Artificial Sequence
  Description of Artificial Sequence: Synthetic peptide
LDCIYFGQIKVCRA

SEQ ID NO: 2040 - protein, 14 aa, Artificial Sequence
  Description of Artificial Sequence: Synthetic peptide
LYCAELHGFRVCRL

SEQ ID NO: 2041 - protein, 14 aa, Artificial Sequence
  Description of Artificial Sequence: Synthetic peptide
LQCTVINSFKLCRL

SEQ ID NO: 2042 - protein, 14 aa, Artificial Sequence
  Description of Artificial Sequence: Synthetic peptide
LYCIESYNLRSCRI

SEQ ID NO: 2043 - protein, 14 aa, Artificial Sequence
  Description of Artificial Sequence: Synthetic peptide
VYCAEIGEYRVCRQ

SEQ ID NO: 2044 - protein, 14 aa, Artificial Sequence
  Description of Artificial Sequence: Synthetic peptide
VQCVFIAPYKLCRS

SEQ ID NO: 2045 - protein, 14 aa, Artificial Sequence
  Description of Artificial Sequence: Synthetic peptide
VHCMSFEGQRVCRA

SEQ ID NO: 2046 - protein, 14 aa, Artificial Sequence
  Description of Artificial Sequence: Synthetic peptide
VFCIDFPVYRVCRA

SEQ ID NO: 2047 - protein, 14 aa, Artificial Sequence
  Description of Artificial Sequence: Synthetic peptide
VFCTTIHGQKLCRA

SEQ ID NO: 2048 - protein, 14 aa, Artificial Sequence
  Description of Artificial Sequence: Synthetic peptide
VVCAYFWDQKVCRE

SEQ ID NO: 2049 - protein, 14 aa, Artificial Sequence
  Description of Artificial Sequence: Synthetic peptide
VYCAKFDEVKVCRA

SEQ ID NO: 2050 - protein, 17 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a small hydrophobic side chain or any amino acid comprising a polar/neutral side chain
  MOD_RES (3)..(3): Any amino acid comprising a large hydrophobic side chain
  MOD_RES (4)..(4): Any amino acid comprising a large hydrophobic side chain
  MOD_RES (6)..(6): Any amino acid comprising a large hydrophobic side chain
  MOD_RES (7)..(7): Any amino acid comprising a basic side chain or any amino acid comprising a polar/neutral side chain
  MOD_RES (8)..(8): Any amino acid comprising a large hydrophobic side chain
  MOD_RES (9)..(9): Any amino acid comprising a small hydrophobic side chain
  MOD_RES (10)..(10): Any amino acid comprising a small hydrophobic side chain
  MOD_RES (11)..(11): Any amino acid
  MOD_RES (12)..(12): Any amino acid comprising a basic side chain or any amino acid comprising a large hydrophobic side chain
  MOD_RES (13)..(13): Any amino acid comprising a large hydrophobic side chain
  MOD_RES (15)..(15): Any amino acid comprising a basic side chain
  MOD_RES (16)..(16): Any amino acid comprising a small hydrophobic side chain
  MOD_RES (17)..(17): Any amino acid comprising a polar/neutral side chain
XXXXCXXXXXXXXCXXX

SEQ ID NO: 2051 - protein, 16 aa, Artificial Sequence
  Description of Artificial Sequence: Synthetic peptide
  MOD_RES (1)..(1): Any amino acid comprising a small hydrophobic side chain or any amino acid comprising a polar/neutral side chain
  MOD_RES (2)..(2): Any amino acid comprising a large hydrophobic side chain
  MOD_RES (3)..(3): Any amino acid comprising a large hydrophobic side chain
  MOD_RES (5)..(5): Any amino acid comprising a large hydrophobic side chain
  MOD_RES (6)..(6): Any amino acid comprising a basic side chain or any amino acid comprising a polar/neutral side chain
  MOD_RES (7)..(7): Any amino acid comprising a large hydrophobic side chain
  MOD_RES (8)..(8): Any amino acid comprising a small hydrophobic side chain
  MOD_RES (9)..(9): Any amino acid comprising a small hydrophobic side chain
  MOD_RES (10)..(10): Any amino acid
  MOD_RES (11)..(11): Any amino acid comprising a basic side chain or any amino acid comprising a large hydrophobic side chain
  MOD_RES (12)..(12): Any amino acid comprising a large hydrophobic side chain
  MOD_RES (14)..(14): Any amino acid comprising a basic side chain
  MOD_RES (15)..(15): Any amino acid comprising a small hydrophobic side chain
  MOD_RES (16)..(16): Any amino acid comprising a polar/neutral side chain
XXXCXXXXXXXXCXXX

SEQ ID NO: 2052 - protein, 14 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a large hydrophobic side chain
  MOD_RES (4)..(4): Any amino acid comprising a large hydrophobic side chain
  MOD_RES (5)..(5): Any amino acid comprising a basic side chain or any amino acid comprising a polar/neutral side chain
  MOD_RES (6)..(6): Any amino acid comprising a large hydrophobic side chain
  MOD_RES (7)..(7): Any amino acid comprising a small hydrophobic side chain
  MOD_RES (8)..(8): Any amino acid comprising a small hydrophobic side chain
  MOD_RES (9)..(9): Any amino acid
  MOD_RES (10)..(10): Any amino acid comprising a basic side chain or any amino acid comprising a large hydrophobic side chain
  MOD_RES (11)..(11): Any amino acid comprising a large hydrophobic side chain
  MOD_RES (13)..(13): Any amino acid comprising a basic side chain
  MOD_RES (14)..(14): Any amino acid comprising a small hydrophobic side chain
XXCXXXXXXXXCXX

SEQ ID NO: 2053 - protein, 12 aa, Artificial Sequence
  Description of Artificial Sequence: Synthetic peptide
  MOD_RES (1)..(1): Any amino acid comprising a large hydrophobic side chain
  MOD_RES (3)..(3): Any amino acid comprising a large hydrophobic side chain
  MOD_RES (4)..(4): Any amino acid comprising a basic side chain or any amino acid comprising a polar/neutral side chain
  MOD_RES (5)..(5): Any amino acid comprising a large hydrophobic side chain
  MOD_RES (6)..(6): Any amino acid comprising a small hydrophobic side chain
  MOD_RES (7)..(7): Any amino acid comprising a small hydrophobic side chain
  MOD_RES (8)..(8): Any amino acid
  MOD_RES (9)..(9): Any amino acid comprising a basic side chain or any amino acid comprising a large hydrophobic side chain
  MOD_RES (10)..(10): Any amino acid comprising a large hydrophobic side chain
  MOD_RES (12)..(12): Any amino acid comprising a basic side chain
XCXXXXXXXXCX

SEQ ID NO: 2054 - protein, 10 aa, Artificial Sequence
  Description of Artificial Sequence: Synthetic peptide
  MOD_RES (2)..(2): Any amino acid comprising a large hydrophobic side chain
  MOD_RES (3)..(3): Any amino acid comprising a basic side chain or any amino acid comprising a polar/neutral side chain
  MOD_RES (4)..(4): Any amino acid comprising a large hydrophobic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid
  MOD_RES (8)..(8): Any amino acid comprising a basic side chain or any amino acid comprising a large hydrophobic side chain
  MOD_RES (9)..(9): Any amino acid comprising a large hydrophobic side chain
CXXXXXXXXC

SEQ ID NO: 2055 - protein, 8 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a basic side chain or any amino acid comprising a polar/neutral side chain
  MOD_RES (3)..(3): Any amino acid comprising a large hydrophobic side chain
  MOD_RES (4)..(4): Any amino acid comprising a small hydrophobic side chain
  MOD_RES (5)..(5): Any amino acid comprising a small hydrophobic side chain
  MOD_RES (6)..(6): Any amino acid
  MOD_RES (7)..(7): Any amino acid comprising a basic side chain or any amino acid comprising a large hydrophobic side chain
  MOD_RES (8)..(8): Any amino acid comprising a large hydrophobic side chain
XXXXXXXX

SEQ ID NO: 2056 - protein, 16 aa, Artificial Sequence
  Description of Artificial Sequence: Synthetic peptide
GVYCLLGPGTVPCRAL

SEQ ID NO: 2057 - protein, 16 aa, Artificial Sequence
  Description of Artificial Sequence: Synthetic peptide
HVYCLHGPGSVPCRSH

SEQ ID NO: 2058 - protein, 16 aa, Artificial Sequence
  Description of Artificial Sequence: Synthetic peptide
HVYCLHGPGSVPCRSH

SEQ ID NO: 2059 - protein, 16 aa, Artificial Sequence
  Description of Artificial Sequence: Synthetic peptide
LVFCEMFPGGRVCRGE

SEQ ID NO: 2060 - protein, 16 aa, Artificial Sequence
  Description of Artificial Sequence: Synthetic peptide
NIACMRFPGGYVCRNY

SEQ ID NO: 2061 - protein, 16 aa, Artificial Sequence
  Description of Artificial Sequence: Synthetic peptide
NIACMRFPGGYVCRNY

SEQ ID NO: 2062 - protein, 16 aa, Artificial Sequence
  Description of Artificial Sequence: Synthetic peptide
PVYCMELPGHRVCRGS

SEQ ID NO: 2063 - protein, 14 aa, Artificial Sequence
  Description of Artificial Sequence: Synthetic peptide
PIYCAKLPGGYNCR

SEQ ID NO: 2064 - protein, 16 aa, Artificial Sequence
  Description of Artificial Sequence: Synthetic peptide
PVVCATLPGGYVCRVT

SEQ ID NO: 2065 - protein, 16 aa, Artificial Sequence
  Description of Artificial Sequence: Synthetic peptide
PVYCMELPGHRVCRGS

SEQ ID NO: 2066 - protein, 16 aa, Artificial Sequence
  Description of Artificial Sequence: Synthetic peptide
QVYCQVFPGFKACRTR

SEQ ID NO: 2067 - protein, 16 aa, Artificial Sequence
  Description of Artificial Sequence: Synthetic peptide
RVFCINLPGQRVCRLS

SEQ ID NO: 2068 - protein, 16 aa, Artificial Sequence
  Description of Artificial Sequence: Synthetic peptide
RIFCVTLPGGKSCRTF

SEQ ID NO: 2069 - protein, 16 aa, Artificial Sequence
  Description of Artificial Sequence: Synthetic peptide
RIYCMVLPGGYNCRAN

SEQ ID NO: 2070 - protein, 16 aa, Artificial Sequence
  Description of Artificial Sequence: Synthetic peptide
SVFCVQFPGYKVCRSS

SEQ ID NO: 2071 - protein, 16 aa, Artificial Sequence
  Description of Artificial Sequence: Synthetic peptide
TIACVNLPGGYVCREY

SEQ ID NO: 2072 - protein, 16 aa, Artificial Sequence
  Description of Artificial Sequence: Synthetic peptide
VVYCIQFPGYKVCRSR

SEQ ID NO: 2073 - protein, 16 aa, Artificial Sequence
  Description of Artificial Sequence: Synthetic peptide
VQCVTNLPGIQKVCRS

SEQ ID NO: 2074 - protein, 15 aa, Artificial Sequence
  Description of Artificial Sequence: Synthetic peptide
  MOD_RES (1)..(1): C, K, R, S, or V
  MOD_RES (2)..(2): C or S
  MOD_RES (3)..(3): K, L, R, or S
  MOD_RES (4)..(4): G, H, R, S, or T
  MOD_RES (5)..(5): G, R, T, V, or W
  MOD_RES (6)..(6): D, F, P, or R
  MOD_RES (7)..(7): L, M, or W
  MOD_RES (8)..(8): D, E, or V
  MOD_RES (9)..(9): L, N, P, or S
  MOD_RES (10)..(10): D, F, L, or W
  MOD_RES (11)..(11): L, N, or W
  MOD_RES (12)..(12): G, I, L, or Q
  MOD_RES (13)..(13): C, F, N, or S
  MOD_RES (14)..(14): C, I or R
  MOD_RES (15)..(15): L or N
XXXXXXXXXXXXXXX

SEQ ID NO: 2075 - protein, 13 aa, Artificial Sequence
  Description of Artificial Sequence: Synthetic peptide
  MOD_RES (1)..(1): C or S
  MOD_RES (2)..(2): K, L, R, or S
  MOD_RES (3)..(3): G, H, R, S, or T
  MOD_RES (4)..(4): G, R, T, V, or W
  MOD_RES (5)..(5): D, F, P, or R
  MOD_RES (6)..(6): L, M, or W
  MOD_RES (7)..(7): D, E, or V
  MOD_RES (8)..(8): L, N, P, or S
  MOD_RES (9)..(9): D, F, L, or W
  MOD_RES (10)..(10): L, N, or W
  MOD_RES (11)..(11): G, I, L, or Q
  MOD_RES (12)..(12): C, F, N, or S
  MOD_RES (13)..(13): C, I or R
XXXXXXXXXXXXX

SEQ ID NO: 2076 - protein, 11 aa, Artificial Sequence
  Description of Artificial Sequence: Synthetic peptide
  MOD_RES (1)..(1): K, L, R, or S
  MOD_RES (2)..(2): G, H, R, S, or T
  MOD_RES (3)..(3): G, R, T, V, or W
  MOD_RES (4)..(4): D, F, P, or R
  MOD_RES (5)..(5): L, M, or W
  MOD_RES (6)..(6): D, E, or V
  MOD_RES (7)..(7): L, N, P, or S
  MOD_RES (8)..(8): D, F, L, or W
  MOD_RES (9)..(9): L, N, or W
  MOD_RES (10)..(10): G, I, L, or Q
  MOD_RES (11)..(11): C, F, N, or S
XXXXXXXXXXX

SEQ ID NO: 2077 - protein, 9 aa, Artificial Sequence
  Description of Artificial Sequence: Synthetic peptide
  MOD_RES (1)..(1): G, H, R, S, or T
  MOD_RES (2)..(2): G, R, T, V, or W
  MOD_RES (3)..(3): D, F, P, or R
  MOD_RES (4)..(4): L, M, or W
  MOD_RES (5)..(5): D, E, or V
  MOD_RES (6)..(6): L, N, P, or S
  MOD_RES (7)..(7): D, F, L, or W
  MOD_RES (8)..(8): L, N, or W
  MOD_RES (9)..(9): G, I, L, or Q
XXXXXXXXX

SEQ ID NO: 2078 - protein, 14 aa, Artificial Sequence
  Description of Artificial Sequence: Synthetic peptide
CSRRVPWVLDNIFC

SEQ ID NO: 2079 - protein, 15 aa, Artificial Sequence
  Description of Artificial Sequence: Synthetic peptide
KCSSRRLDLWWLNCN

SEQ ID NO: 2080 - protein, 15 aa, Artificial Sequence
  Description of Artificial Sequence: Synthetic peptide
RCKGGFMVPFLGSCL

SEQ ID NO: 2081 - protein, 14 aa, Artificial Sequence
  Description of Artificial Sequence: Synthetic peptide
SCLHWDLESLLQCI

SEQ ID NO: 2082 - protein, 14 aa, Artificial Sequence
  Description of Artificial Sequence: Synthetic peptide
VCRTTRLDNWWGCR

SEQ ID NO: 2083 - protein, 12 aa, Artificial Sequence
  Description of Artificial Sequence: Synthetic peptide
ANRVHVQQGFWW

SEQ ID NO: 2084 - protein, 14 aa, Artificial Sequence
  Description of Artificial Sequence: Synthetic peptide
FVFCGQDYQMCKNF

SEQ ID NO: 2085 - protein, 12 aa, Artificial Sequence
  Description of Artificial Sequence: Synthetic peptide
GDSQVAYWSPYA

SEQ ID NO: 2086 - protein, 15 aa, Artificial Sequence
  Description of Artificial Sequence: Synthetic peptide
HCRLQKPGFHRSSCY

SEQ ID NO: 2087 - protein, 14 aa, Artificial Sequence
  Description of Artificial Sequence: Synthetic peptide
HCRLQKPGFHRSSC

SEQ ID NO: 2088 - protein, 15 aa, Artificial Sequence
  Description of Artificial Sequence: Synthetic peptide
ISCYFPAGLKPLCRY

SEQ ID NO: 2089 - protein, 13 aa, Artificial Sequence
  Description of Artificial Sequence: Synthetic peptide
KEAGGPPGGEGGR

SEQ ID NO: 2090 - protein, 15 aa, Artificial Sequence
  Description of Artificial Sequence: Synthetic peptide
KLCRGGWVWLDWCVN

SEQ ID NO: 2091 - protein, 15 aa, Artificial Sequence
  Description of Artificial Sequence: Synthetic peptide
LVCWTHWSNQRLCRT

SEQ ID NO: 2092 - protein, 15 aa, Artificial Sequence
  Description of Artificial Sequence: Synthetic peptide
LHCWEHWLGTKICRL

SEQ ID NO: 2093 - protein, 16 aa, Artificial Sequence
  Description of Artificial Sequence: Synthetic peptide
LVFCEMFPGGRVCRGE

SEQ ID NO: 2094 - protein, 15 aa, Artificial Sequence
  Description of Artificial Sequence: Synthetic peptide
NVFCVYFDSKVCRTR

SEQ ID NO: 2095 - protein, 14 aa, Artificial Sequence
  Description of Artificial Sequence: Synthetic peptide
NVFCVYFDSKVCRT

SEQ ID NO: 2096 - protein, 15 aa, Artificial Sequence
  Description of Artificial Sequence: Synthetic peptide
QNCYELRDAALMCAM

SEQ ID NO: 2097 - protein, 16 aa, Artificial Sequence
  Description of Artificial Sequence: Synthetic peptide
QVCCIHFPGRMVCRAC

SEQ ID NO: 2098 - protein, 12 aa, Artificial Sequence
  Description of Artificial Sequence: Synthetic peptide
SRDVRELIVIAS

SEQ ID NO: 2099 - protein, 12 aa, Artificial Sequence
  Description of Artificial Sequence: Synthetic peptide
TVLSFEAWQILF

SEQ ID NO: 2100 - protein, 15 aa, Artificial Sequence
  Description of Artificial Sequence: Synthetic peptide
VCCVDLNSVKICRRC

SEQ ID NO: 2101 - protein, 16 aa, Artificial Sequence
  Description of Artificial Sequence: Synthetic peptide
WRICCINPGLRVCRQC

SEQ ID NO: 2102 - protein, 12 aa, Artificial Sequence
  Description of Artificial Sequence: Synthetic peptide
YRQLCLDALLSI

SEQ ID NO: 2103 - protein, 14 aa, Artificial Sequence
  Description of Artificial Sequence: Synthetic peptide
YWACSSGMNLCRWN

SEQ ID NO: 2104 - protein, 14 aa, Artificial Sequence
  Description of Artificial Sequence: Synthetic peptide
YMACSSGLSLCRLS

SEQ ID NO: 2105 - protein, 14 aa, Artificial Sequence
  Description of Artificial Sequence: Synthetic peptide
YLACSTTLGKCRWN

SEQ ID NO: 2106 - protein, 28 aa, Artificial Sequence
  Description of Artificial Sequence: Synthetic peptide
  MOD_RES (1)..(1): Any amino acid comprising a small hydrophobic side chain
  MOD_RES (2)..(2): Any amino acid
  MOD_RES (3)..(3): Any amino acid comprising a polar/neutral side chain
  MOD_RES (4)..(4): Any amino acid comprising a polar neutral side chain or any amino acid comprising a basic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid comprising a polar/neutral hydrophobic side chain, or amino acid comprising an acidic side chain, or any amino acid comprising an aromatic side chain
  MOD_RES (9)..(9): Any amino acid comprising a large hydrophobic side chain
  MOD_RES (10)..(10): Any amino acid comprising a basic side chain
  MOD_RES (11)..(11): Any amino acid comprising a large hydrophobic side chain
  MOD_RES (12)..(12): Any amino acid comprising an acidic side chain
  MOD_RES (13)..(13): Any amino acid comprising a large hydrophobic side chain
  MOD_RES (14)..(14): Any amino acid comprising an acidic side chain
  MOD_RES (15)..(15): Any amino acid comprising a hydroxyl-containing side chain
  MOD_RES (16)..(16): Any amino acid comprising a large hydrophobic side chain
  MOD_RES (17)..(17): Any amino acid comprising a large hydrophobic side chain
  MOD_RES (18)..(18): Any amino acid comprising a small hydrophobic side chain
  MOD_RES (20)..(20): Any amino acid comprising a large hydrophobic side chain
  MOD_RES (21)..(21): Any amino acid comprising an acidic side chain, any amino acid comprising a polar/neutral side chain, or any amino acid comprising a basic side chain
  MOD_RES (22)..(22): Any amino acid
  MOD_RES (23)..(23): Any amino acid
  MOD_RES (24)..(24): Any amino acid
  MOD_RES (25)..(25): Any amino acid
  MOD_RES (26)..(26): Any amino acid
  MOD_RES (27)..(27): Any amino acid
  MOD_RES (28)..(28): Any amino acid
XXXXXXXCXXXXXXXXXXCXXXXXXXXX

SEQ ID NO: 2107 - protein, 18 aa, Artificial Sequence
  Description of Artificial Sequence: Synthetic peptide
  MOD_RES (1)..(1): Any amino acid comprising a small hydrophobic side chain
  MOD_RES (2)..(2): Any amino acid comprising a small hydrophobic side chain
  MOD_RES (3)..(3): Any amino acid comprising a polar/neutral hydrophobic side chain, or amino acid comprising an acidic side chain, or any amino acid comprising an aromatic side chain
  MOD_RES (5)..(5): Any amino acid comprising a large hydrophobic side chain
  MOD_RES (6)..(6): Any amino acid comprising a basic side chain
  MOD_RES (7)..(7): Any amino acid comprising a large hydrophobic side chain
  MOD_RES (8)..(8): Any amino acid comprising an acidic side chain
  MOD_RES (9)..(9): Any amino acid comprising a large hydrophobic side chain
  MOD_RES (10)..(10): Any amino acid comprising an acidic side chain
  MOD_RES (11)..(11): Any amino acid comprising a hydroxyl-containing side chain
  MOD_RES (12)..(12): Any amino acid comprising a large hydrophobic side chain
  MOD_RES (13)..(13): Any amino acid comprising a large hydrophobic side chain
  MOD_RES (14)..(14): Any amino acid comprising a small hydrophobic side chain
  MOD_RES (16)..(16): Any amino acid comprising a large hydrophobic side chain
  MOD_RES (17)..(17): Any amino acid comprising an acidic side chain, any amino acid comprising a polar/neutral side chain, or any amino acid comprising a basic side chain
  MOD_RES (18)..(18): Any amino acid
XXXCXXXXXXXXXXCXXX

SEQ ID NO: 2108 - protein, 16 aa, Artificial Sequence
  Description of Artificial Sequence: Synthetic peptide
  MOD_RES (1)..(1): Any amino acid comprising a small hydrophobic side chain
  MOD_RES (2)..(2): Any amino acid comprising a polar/neutral hydrophobic side chain, or amino acid comprising an acidic side chain, or any amino acid comprising an aromatic side chain
  MOD_RES (4)..(4): Any amino acid comprising a large hydrophobic side chain
  MOD_RES (5)..(5): Any amino acid comprising a basic side chain
  MOD_RES (6)..(6): Any amino acid comprising a large hydrophobic side chain
  MOD_RES (7)..(7): Any amino acid comprising an acidic side chain
  MOD_RES (8)..(8): Any amino acid comprising a large hydrophobic side chain
  MOD_RES (9)..(9): Any amino acid comprising an acidic side chain
  MOD_RES (10)..(10): Any amino acid comprising a hydroxyl-containing side chain
  MOD_RES (11)..(11): Any amino acid comprising a large hydrophobic side chain
  MOD_RES (12)..(12): Any amino acid comprising a large hydrophobic side chain
  MOD_RES (13)..(13): Any amino acid comprising a small hydrophobic side chain
  MOD_RES (15)..(15): Any amino acid comprising a large hydrophobic side chain
  MOD_RES (16)..(16): Any amino acid comprising an acidic side chain, any amino acid comprising a polar/neutral side chain, or any amino acid comprising a basic side chain
XXCXXXXXXXXXXCXX

SEQ ID NO: 2109 - protein, 14 aa, Artificial Sequence
  Description of Artificial Sequence: Synthetic peptide
  MOD_RES (1)..(1): Any amino acid comprising a polar/neutral hydrophobic side chain, or amino acid comprising an acidic side chain, or any amino acid comprising an aromatic side chain
  MOD_RES (3)..(3): Any amino acid comprising a large hydrophobic side chain
  MOD_RES (4)..(4): Any amino acid comprising a basic side chain
  MOD_RES (5)..(5): Any amino acid comprising a large hydrophobic side chain
  MOD_RES (6)..(6): Any amino acid comprising an acidic side chain
  MOD_RES (7)..(7): Any amino acid comprising a large hydrophobic side chain
  MOD_RES (8)..(8): Any amino acid comprising an acidic side chain
  MOD_RES (9)..(9): Any amino acid comprising a hydroxyl-containing side chain
  MOD_RES (10)..(10): Any amino acid comprising a large hydrophobic side chain
  MOD_RES (11)..(11): Any amino acid comprising a large hydrophobic side chain
  MOD_RES (12)..(12): Any amino acid comprising a small hydrophobic side chain
  MOD_RES (14)..(14): Any amino acid comprising a large hydrophobic side chain
XCXXXXXXXXXXCX

SEQ ID NO: 2110 - protein, 12 aa, Artificial Sequence
  Description of Artificial Sequence: Synthetic peptide
  MOD_RES (2)..(2): Any amino acid comprising a large hydrophobic side chain
  MOD_RES (3)..(3): Any amino acid comprising a basic side chain
  MOD_RES (4)..(4): Any amino acid comprising a large hydrophobic side chain
  MOD_RES (5)..(5): Any amino acid comprising an acidic side chain
  MOD_RES (6)..(6): Any amino acid comprising a large hydrophobic side chain
  MOD_RES (7)..(7): Any amino acid comprising an acidic side chain
  MOD_RES (8)..(8): Any amino acid comprising a hydroxyl-containing side chain
  MOD_RES (9)..(9): Any amino acid comprising a large hydrophobic side chain
  MOD_RES (10)..(10): Any amino acid comprising a large hydrophobic side chain
  MOD_RES (11)..(11): Any amino acid comprising a small hydrophobic side chain
CXXXXXXXXXXC

SEQ ID NO: 2111 - protein, 10 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a basic side chain
  MOD_RES (3)..(3): Any amino acid comprising a large hydrophobic side chain
  MOD_RES (4)..(4): Any amino acid comprising an acidic side chain
  MOD_RES (5)..(5): Any amino acid comprising a large hydrophobic side chain
  MOD_RES (6)..(6): Any amino acid comprising an acidic side chain
  MOD_RES (7)..(7): Any amino acid comprising a hydroxyl-containing side chain
  MOD_RES (8)..(8): Any amino acid comprising a large hydrophobic side chain
  MOD_RES (9)..(9): Any amino acid comprising a large hydrophobic side chain
  MOD_RES (10)..(10): Any amino acid comprising a small hydrophobic side chain
XXXXXXXXXX

SEQ ID NO: 2112 - protein, 19 aa, Artificial Sequence
  Description of Artificial Sequence: Synthetic peptide
DSKQEQCFHWDLESLLSCL

SEQ ID NO: 2113 - protein, 14 aa, Artificial Sequence
  Description of Artificial Sequence: Synthetic peptide
DCMHWDLESLLACV

SEQ ID NO: 2114 - protein, 14 aa, Artificial Sequence
  Description of Artificial Sequence: Synthetic peptide
DCIHWDLESLLRCV

SEQ ID NO: 2115 - protein, 14 aa, Artificial Sequence
  Description of Artificial Sequence: Synthetic peptide
DCYHWDLESLLACL

SEQ ID NO: 2116 - protein, 14 aa, Artificial Sequence
  Description of Artificial Sequence: Synthetic peptide
DCFHWDMESLLRCV

SEQ ID NO: 2117 - protein, 14 aa, Artificial Sequence
  Description of Artificial Sequence: Synthetic peptide
ECMHWDLESLLACV

SEQ ID NO: 2118 - protein, 20 aa, Artificial Sequence
  Description of Artificial Sequence: Synthetic peptide
EDFQGYQCFHWDIESLLSCI

SEQ ID NO: 2119 - protein, 14 aa, Artificial Sequence
  Description of Artificial Sequence: Synthetic peptide
ECIHWDLESLLSCV

SEQ ID NO: 2120 - protein, 20 aa, Artificial Sequence
  Description of Artificial Sequence: Synthetic peptide
FCMHWDMESLLACVQGAAMQ

SEQ ID NO: 2121 - protein, 20 aa, Artificial Sequence
  Description of Artificial Sequence: Synthetic peptide
HCLHWDIETLMSCVYGNFEE

SEQ ID NO: 2122 - protein, 20 aa, Artificial Sequence
  Description of Artificial Sequence: Synthetic peptide
HCNHWDFESLVSCVKDWSWS

SEQ ID NO: 2123 - protein, 14 aa, Artificial Sequence
  Description of Artificial Sequence: Synthetic peptide
HCKHWDLESLLLCV

SEQ ID NO: 2124 - protein, 20 aa, Artificial Sequence
  Description of Artificial Sequence: Synthetic peptide
HCKHWDIESLLSCVGIRLEP

SEQ ID NO: 2125 - protein, 20 aa, Artificial Sequence
  Description of Artificial Sequence: Synthetic peptide
HCVHWDLESLLSCVNMQKLK

SEQ ID NO: 2126 - protein, 20 aa, Artificial Sequence
  Description of Artificial Sequence: Synthetic peptide
HCIHWDLESLLACVQMHKGS

SEQ ID NO: 2127 - protein, 20 aa, Artificial Sequence
  Description of Artificial Sequence: Synthetic peptide
HCMHWDMETLLECVRQWKIT

SEQ ID NO: 2128 - protein, 20 aa, Artificial Sequence
  Description of Artificial Sequence: Synthetic peptide
HCIHWDLESLLSCVEDRRDR

SEQ ID NO: 2129 - protein, 20 aa, Artificial Sequence
  Description of Artificial Sequence: Synthetic peptide
HCVHWDLESLLSCVNEPRFK

SEQ ID NO: 2130 - protein, 20 aa, Artificial Sequence
  Description of Artificial Sequence: Synthetic peptide
HCNHWDLESLLSCVRNGAEQ

SEQ ID NO: 2131 - protein, 20 aa, Artificial Sequence
  Description of Artificial Sequence: Synthetic peptide
HCIHWDLDSLLACVMGQRNQ

SEQ ID NO: 2132 - protein, 20 aa, Artificial Sequence
  Description of Artificial Sequence: Synthetic peptide
HCMHSDMQTLFACMRDHIYA

SEQ ID NO: 2133 - protein, 14 aa, Artificial Sequence
  Description of Artificial Sequence: Synthetic peptide
HCMHWDLESLLACV

SEQ ID NO: 2134 - protein, 20 aa, Artificial Sequence
  Description of Artificial Sequence: Synthetic peptide
HCIHWDLESLLACVMGQRNQ

SEQ ID NO: 2135 - protein, 20 aa, Artificial Sequence
  Description of Artificial Sequence: Synthetic peptide
HCVHWDLESLLDCVRRQPLK

SEQ ID NO: 2136 - protein, 14 aa, Artificial Sequence
  Description of Artificial Sequence: Synthetic peptide
HCNHWDLESLLSCV

SEQ ID NO: 2137 - protein, 14 aa, Artificial Sequence
  Description of Artificial Sequence: Synthetic peptide
HCFHWDLESLLACV

SEQ ID NO: 2138 - protein, 14 aa, Artificial Sequence
  Description of Artificial Sequence: Synthetic peptide
HCIHWDMESLIACV

SEQ ID NO: 2139 - protein, 14 aa, Artificial Sequence
  Description of Artificial Sequence: Synthetic peptide
HCVHWDLESLLSCV

SEQ ID NO: 2140 - protein, 14 aa, Artificial Sequence
  Description of Artificial Sequence: Synthetic peptide
HCIHWDLDSLLSCV

SEQ ID NO: 2141 - protein, 20 aa, Artificial Sequence
  Description of Artificial Sequence: Synthetic peptide
IHSSWAQCMHWDLESLISCV

SEQ ID NO: 2142 - protein, 20 aa, Artificial Sequence
  Description of Artificial Sequence: Synthetic peptide
MGLQCTHWDFDSLMACKREL

SEQ ID NO: 2143 - protein, 20 aa, Artificial Sequence
  Description of Artificial Sequence: Synthetic peptide
NCLHWDLESLLSCVSDLREG

SEQ ID NO: 2144 - protein, 20 aa, Artificial Sequence
  Description of Artificial Sequence: Synthetic peptide
NMRHCLHWDMESLMACVNQW

SEQ ID NO: 2145 - protein, 20 aa, Artificial Sequence
  Description of Artificial Sequence: Synthetic peptide
NCMHWDIESLLQCVRQIRDY

SEQ ID NO: 2146 - protein, 20 aa, Artificial Sequence
  Description of Artificial Sequence: Synthetic peptide
QCVHWDLDTLFGCIREQLEL

SEQ ID NO: 2147 - protein, 20 aa, Artificial Sequence
  Description of Artificial Sequence: Synthetic peptide
QGSRFTECMHWDIESLLSCI

SEQ ID NO: 2148 - protein, 20 aa, Artificial Sequence
  Description of Artificial Sequence: Synthetic peptide
QCIHWDLESLLNCLRELKEP

SEQ ID NO: 2149 - protein, 20 aa, Artificial Sequence
  Description of Artificial Sequence: Synthetic peptide
QCVHWDITTLLSCVKNLLDE

SEQ ID NO: 2150 - protein, 14 aa, Artificial Sequence
  Description of Artificial Sequence: Synthetic peptide
QCFHWDFESLMSCV

SEQ ID NO: 2151 - protein, 14 aa, Artificial Sequence
  Description of Artificial Sequence: Synthetic peptide
QCLHWDLESLLACV

SEQ ID NO: 2152 - protein, 14 aa, Artificial Sequence
  Description of Artificial Sequence: Synthetic peptide
QCVHWDFESLLACV

SEQ ID NO: 2153 - protein, 20 aa, Artificial Sequence
  Description of Artificial Sequence: Synthetic peptide
QMFGCIHWDLETLLMCVEKL

SEQ ID NO: 2154 - protein, 20 aa, Artificial Sequence
  Description of Artificial Sequence: Synthetic peptide
QCIHWDLESLLSCVESERRL

SEQ ID NO: 2155 - protein, 20 aa, Artificial Sequence
  Description of Artificial Sequence: Synthetic peptide
QGMNCSHWDLETLLDCMRTL

SEQ ID NO: 2156 - protein, 14 aa, Artificial Sequence
  Description of Artificial Sequence: Synthetic peptide
QCIHWDIETLLSCV

SEQ ID NO: 2157 - protein, 14 aa, Artificial Sequence
  Description of Artificial Sequence: Synthetic peptide
QCFHWDLESLLSCL

SEQ ID NO: 2158 - protein, 20 aa, Artificial Sequence
  Description of Artificial Sequence: Synthetic peptide
QTMPCLHWDLESLLFCVKGL

SEQ ID NO: 2159 - protein, 14 aa, Artificial Sequence
  Description of Artificial Sequence: Synthetic peptide
QCIHWDIETLLSCV

SEQ ID NO: 2160 - protein, 14 aa, Artificial Sequence
  Description of Artificial Sequence: Synthetic peptide
QCLHWDLESLLACV

SEQ ID NO: 2161 - protein, 14 aa, Artificial Sequence
  Description of Artificial Sequence: Synthetic peptide
QCVHWDLESLLYCV

SEQ ID NO: 2162 - protein, 14 aa, Artificial Sequence
  Description of Artificial Sequence: Synthetic peptide
QCLHWDLESLLSCV

SEQ ID NO: 2163 - protein, 14 aa, Artificial Sequence
  Description of Artificial Sequence: Synthetic peptide
QCLHWDLESLLSCV

SEQ ID NO: 2164 - protein, 14 aa, Artificial Sequence
  Description of Artificial Sequence: Synthetic peptide
QCMHWDLESLLSCV

SEQ ID NO: 2165 - protein, 14 aa, Artificial Sequence
  Description of Artificial Sequence: Synthetic peptide
QCLHWDLETLLACV

SEQ ID NO: 2166 - protein, 20 aa, Artificial Sequence
  Description of Artificial Sequence: Synthetic peptide
RMYVRDQCISLDMDTFLSCL

SEQ ID NO: 2167 - protein, 20 aa, Artificial Sequence
  Description of Artificial Sequence: Synthetic peptide
RRIHCMKWEFDTLMWCRGPQ

SEQ ID NO: 2168 - protein, 20 aa, Artificial Sequence
  Description of Artificial Sequence: Synthetic peptide
RTRQCNHWDLESLLMCIQNL

SEQ ID NO: 2169 - protein, 19 aa, Artificial Sequence
  Description of Artificial Sequence: Synthetic peptide
RLIQSPCMHWDLESLLLCV

SEQ ID NO: 2170 - protein, 20 aa, Artificial Sequence
  Description of Artificial Sequence: Synthetic peptide
SAKVLKQCLHWDLESLLSCL

SEQ ID NO: 2171 - protein, 20 aa, Artificial Sequence
  Description of Artificial Sequence: Synthetic peptide
SRRQCVKKDLGTFWSCFKAP

SEQ ID NO: 2172 - protein, 20 aa, Artificial Sequence
  Description of Artificial Sequence: Synthetic peptide
SSSRLMQCMHWDLESLLQCV

SEQ ID NO: 2173 - protein, 20 aa, Artificial Sequence
  Description of Artificial Sequence: Synthetic peptide
TVQPSSHCFHWDIDSLLSCL

SEQ ID NO: 2174 - protein, 20 aa, Artificial Sequence
  Description of Artificial Sequence: Synthetic peptide
VRAQCMHWDLESLLSCVDRS

SEQ ID NO: 2175 - protein, 19 aa, Artificial Sequence
  Description of Artificial Sequence: Synthetic peptide
WGTKAYCNHWDLESLLACV

SEQ ID NO: 2176 - protein, 16 aa, Artificial Sequence
  Description of Artificial Sequence: Synthetic peptide
WGQCMHWDLESLLSCV

SEQ ID NO: 2177 - protein, 20 aa, Artificial Sequence
  Description of Artificial Sequence: Synthetic peptide
YCMHWDLESLLWCVHRKELE

SEQ ID NO: 2178 - protein, 20 aa, Artificial Sequence
  Description of Artificial Sequence: Synthetic peptide
YCPHFDIDSLLDCVRQSTWY

SEQ ID NO: 2179 - protein, 14 aa, Artificial Sequence
  Description of Artificial Sequence: Synthetic peptide
YCFHWDLESLISCV

SEQ ID NO: 2180 - protein, 20 aa, Artificial Sequence
  Description of Artificial Sequence: Synthetic peptide
YCAHWDLESLLSCVEGLSRS

SEQ ID NO: 2181 - protein, 20 aa, Artificial Sequence
  Description of Artificial Sequence: Synthetic peptide
YCIHWDLESLLSCVSYNERH

SEQ ID NO: 2182 - protein, 20 aa, Artificial Sequence
  Description of Artificial Sequence: Synthetic peptide
YCFHWDLETLMQCVAKGSNR

SEQ ID NO: 2183 - protein, 14 aa, Artificial Sequence
  Description of Artificial Sequence: Synthetic peptide
YCMHWDLETLLACV

SEQ ID NO: 2184 - protein, 28 aa, Artificial Sequence
  Description of Artificial Sequence: Synthetic peptide
  MOD_RES (1)..(1): Any amino acid
  MOD_RES (2)..(2): Any amino acid
  MOD_RES (3)..(3): Any amino acid
  MOD_RES (4)..(4): Any amino acid
  MOD_RES (5)..(5): Any amino acid
  MOD_RES (6)..(6): Any amino acid
  MOD_RES (7)..(7): Any amino acid comprising a large hydrophobic side chain
  MOD_RES (8)..(8): Any amino acid comprising a small hydrophobic side chain
  MOD_RES (9)..(9): Any amino acid comprising a large hydrophobic side chain
  MOD_RES (11)..(11): Any amino acid comprising a large hydrophobic side chain or any amino acid comprising a small hydrophobic side chain
  MOD_RES (12)..(12): Any amino acid comprising a large hydrophobic side chain
  MOD_RES (13)..(13): Any amino acid comprising an acidic side chain
  MOD_RES (14)..(14): Any amino acid comprising a small hydrophobic side chain
  MOD_RES (15)..(15): Any amino acid comprising a small hydrophobic side chain
  MOD_RES (16)..(16): Any amino acid comprising a small hydrophobic side chain
  MOD_RES (17)..(17): Any amino acid comprising a large hydrophobic side chain
  MOD_RES (18)..(18): Any amino acid comprising a polar/neutral side chain
  MOD_RES (20)..(20): Any amino acid comprising a small hydrophobic side chain
  MOD_RES (21)..(21): Any amino acid comprising an aromatic side chain
  MOD_RES (22)..(22): Any amino acid comprising a large hydrophobic side chain
  MOD_RES (23)..(23): Any amino acid comprising a polar/neutral side chain
  MOD_RES (24)..(24): Any amino acid comprising a polar/neutral side chain
  MOD_RES (25)..(25): Any amino acid comprising an acidic side chain or any amino acid comprising a polar/neutral side chain
  MOD_RES (26)..(26): Any amino acid
  MOD_RES (27)..(27): Any amino acid
  MOD_RES (28)..(28): Any amino acid
XXXXXXXXXCXXXXXXXXCXXXXXXXXX

SEQ ID NO: 2185 - protein, 18 aa, Artificial Sequence
  Description of Artificial Sequence: Synthetic peptide
  MOD_RES (1)..(1): Any amino acid
  MOD_RES (2)..(2): Any amino acid
  MOD_RES (3)..(3): Any amino acid comprising a large hydrophobic side chain
  MOD_RES (4)..(4): Any amino acid comprising a small hydrophobic side chain
  MOD_RES (5)..(5): Any amino acid comprising a large hydrophobic side chain
  MOD_RES (7)..(7): Any amino acid comprising a large hydrophobic side chain or any amino acid comprising a small hydrophobic side chain
  MOD_RES (8)..(8): Any amino acid comprising a large hydrophobic side chain
  MOD_RES (9)..(9): Any amino acid comprising an acidic side chain
  MOD_RES (10)..(10): Any amino acid comprising a small hydrophobic side chain
  MOD_RES (11)..(11): Any amino acid comprising a small hydrophobic side chain
  MOD_RES (12)..(12): Any amino acid comprising a small hydrophobic side chain
  MOD_RES (13)..(13): Any amino acid comprising a large hydrophobic side chain
  MOD_RES (14)..(14): Any amino acid comprising a polar/neutral side chain
  MOD_RES (16)..(16): Any amino acid comprising a small hydrophobic side chain
  MOD_RES (17)..(17): Any amino acid comprising an aromatic side chain
  MOD_RES (18)..(18): Any amino acid comprising a large hydrophobic side chain
XXXXXCXXXXXXXXCXXX

SEQ ID NO: 2186 - protein, 14 aa, Artificial Sequence
  Description of Artificial Sequence: Synthetic peptide
  MOD_RES (1)..(1): Any amino acid comprising a small hydrophobic side chain
  MOD_RES (2)..(2): Any amino acid comprising a large hydrophobic side chain
  MOD_RES (4)..(4): Any amino acid comprising a large hydrophobic side chain or any amino acid comprising a small hydrophobic side chain
  MOD_RES (5)..(5): Any amino acid comprising a large hydrophobic side chain
  MOD_RES (6)..(6): Any amino acid comprising an acidic side chain
  MOD_RES (7)..(7): Any amino acid comprising a small hydrophobic side chain
  MOD_RES (8)..(8): Any amino acid comprising a small hydrophobic side chain
  MOD_RES (9)..(9): Any amino acid comprising a small hydrophobic side chain
  MOD_RES (10)..(10): Any amino acid comprising a large hydrophobic side chain
  MOD_RES (11)..(11): Any amino acid comprising a polar/neutral side chain
  MOD_RES (13)..(13): Any amino acid comprising a small hydrophobic side chain
  MOD_RES (14)..(14): Any amino acid comprising an aromatic side chain
XXCXXXXXXXXCXX

SEQ ID NO: 2187 - protein, 12 aa, Artificial Sequence
  Description of Artificial Sequence: Synthetic peptide
  MOD_RES (1)..(1): Any amino acid comprising a large hydrophobic side chain
  MOD_RES (3)..(3): Any amino acid comprising a large hydrophobic side chain or any amino acid comprising a small hydrophobic side chain
  MOD_RES (4)..(4): Any amino acid comprising a large hydrophobic side chain
  MOD_RES (5)..(5): Any amino acid comprising an acidic side chain
  MOD_RES (6)..(6): Any amino acid comprising a small hydrophobic side chain
  MOD_RES (7)..(7): Any amino acid comprising a small hydrophobic side chain
  MOD_RES (8)..(8): Any amino acid comprising a small hydrophobic side chain
  MOD_RES (9)..(9): Any amino acid comprising a large hydrophobic side chain
  MOD_RES (10)..(10): Any amino acid comprising a polar/neutral side chain
  MOD_RES (12)..(12): Any amino acid comprising a small hydrophobic side chain
XCXXXXXXXXCX

SEQ ID NO: 2188 - protein, 10 aa, Artificial Sequence
  Description of Artificial Sequence: Synthetic peptide
  MOD_RES (2)..(2): Any amino acid comprising a large hydrophobic side chain or any amino acid comprising a small hydrophobic side chain
  MOD_RES (3)..(3): Any amino acid comprising a large hydrophobic side chain
  MOD_RES (4)..(4): Any amino acid comprising an acidic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid comprising a small hydrophobic side chain
  MOD_RES (8)..(8): Any amino acid comprising a large hydrophobic side chain
  MOD_RES (9)..(9): Any amino acid comprising a polar/neutral side chain
CXXXXXXXXC

SEQ ID NO: 2189 - protein, 8 aa, Artificial Sequence
  Description of Artificial Sequence: Synthetic peptide
  MOD_RES (1)..(1): Any amino acid comprising a large hydrophobic side chain or any amino acid comprising a small hydrophobic side chain
  MOD_RES (2)..(2): Any amino acid comprising a large hydrophobic side chain
  MOD_RES (3)..(3): Any amino acid comprising an acidic side chain
  MOD_RES (4)..(4): Any amino acid comprising a small hydrophobic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid comprising a large hydrophobic side chain
  MOD_RES (8)..(8): Any amino acid comprising a polar/neutral side chain
XXXXXXXX

SEQ ID NO: 2190 - protein, 22 aa, Artificial Sequence
  Description of Artificial Sequence: Synthetic peptide
ARHVPWCTLDPGSIQCAWLRAN

SEQ ID NO: 2191 - protein, 22 aa, Artificial Sequence
  Description of Artificial Sequence: Synthetic peptide
AHYIPWCTLDPGSLQCAWLQSH

SEQ ID NO: 2192 - protein, 22 aa, Artificial Sequence
  Description of Artificial Sequence: Synthetic peptide
DLSIPWCMLDPGSLQCSYITKF

SEQ ID NO: 2193 - protein, 22 aa, Artificial Sequence
  Description of Artificial Sequence: Synthetic peptide
DRMVTGIPWCLLDPGSIQCAWL

SEQ ID NO: 2194 - protein, 22 aa, Artificial Sequence
  Description of Artificial Sequence: Synthetic peptide
DMSIPWCNLDPGSLQCAWIRAN

SEQ ID NO: 2195 - protein, 22 aa, Artificial Sequence
  Description of Artificial Sequence: Synthetic peptide
ENHWTRIPWCILDPGSIQCAWL

SEQ ID NO: 2196 - protein, 22 aa, Artificial Sequence
  Description of Artificial Sequence: Synthetic peptide
ERRIPWCHLDPGSLQCAWLSRH

SEQ ID NO: 2197 - protein, 22 aa, Artificial Sequence
  Description of Artificial Sequence: Synthetic peptide
  MOD_RES (17)..(17): Any amino acid
EKRFVEIPWCTLDPGSXQCAYL

SEQ ID NO: 2198 - protein, 22 aa, Artificial Sequence
  Description of Artificial Sequence: Synthetic peptide
EFRWSVIPWCTLDPGSVQCAWL

SEQ ID NO: 2199 - protein, 22 aa, Artificial Sequence
  Description of Artificial Sequence: Synthetic peptide
ETRIPWCSLDPDSLQCAYLQAH

SEQ ID NO: 2200 - protein, 21 aa, Artificial Sequence
  Description of Artificial Sequence: Synthetic peptide
EYLGRIPWCTLDPGSLQCAWL

SEQ ID NO: 2201 - protein, 22 aa, Artificial Sequence
  Description of Artificial Sequence: Synthetic peptide
FVSIPWCSLDPGSLQCAWVTYN

SEQ ID NO: 2202 - protein, 22 aa, Artificial Sequence
  Description of Artificial Sequence: Synthetic peptide
FTGVPWCLLDPGSLQCTWLKIG

SEQ ID NO: 2203 - protein, 21 aa, Artificial Sequence
  Description of Artificial Sequence: Synthetic peptide
FVIPWCTLDPGGLQCAFIKGT

SEQ ID NO: 2204 - protein, 22 aa, Artificial Sequence
  Description of Artificial Sequence: Synthetic peptide
HLGVPWCTLDPGSIQCAWLAKH

SEQ ID NO: 2205 - protein, 21 aa, Artificial Sequence
  Description of Artificial Sequence: Synthetic peptide
HSWSEIPWCTLDPGSIQCAWI

SEQ ID NO: 2206 - protein, 22 aa, Artificial Sequence
  Description of Artificial Sequence: Synthetic peptide
HFLGLTIPWCSLDPGSLQCAWI

SEQ ID NO: 2207 - protein, 22 aa, Artificial Sequence
  Description of Artificial Sequence: Synthetic peptide
IRSCLWQPGALHCTWWAEEEPV

SEQ ID NO: 2208 - protein, 22 aa, Artificial Sequence
  Description of Artificial Sequence: Synthetic peptide
IPWCTLDPGSLQCAWLQKFGEG

SEQ ID NO: 2209 - protein, 22 aa, Artificial Sequence
  Description of Artificial Sequence: Synthetic peptide
IPWCILDPGSVQCAWLMQEKKE

SEQ ID NO: 2210 - protein, 22 aa, Artificial Sequence
  Description of Artificial Sequence: Synthetic peptide
IPWCTLDPGSVQCDYLLKSAKQ

SEQ ID NO: 2211 - protein, 22 aa, Artificial Sequence
  Description of Artificial Sequence: Synthetic peptide
IPWCTLDPGSLQCAWLTNTGAK

SEQ ID NO: 2212 - protein, 22 aa, Artificial Sequence
  Description of Artificial Sequence: Synthetic peptide
IPWCTLDPGSLQCAWLQGKEER

SEQ ID NO: 2213 - protein, 22 aa, Artificial Sequence
  Description of Artificial Sequence: Synthetic peptide
IGQVSRVPWCLLDPGSYQCGWL

SEQ ID NO: 2214 - protein, 21 aa, Artificial Sequence
  Description of Artificial Sequence: Synthetic peptide
IQVPWCMLAPGSLQCAYITRH

SEQ ID NO: 2215 - protein, 16 aa, Artificial Sequence
  Description of Artificial Sequence: Synthetic peptide
IPWCTLDPGSLQCAWL

SEQ ID NO: 2216 - protein, 16 aa, Artificial Sequence
  Description of Artificial Sequence: Synthetic peptide
IPWCLLDPGGLQCVWL

SEQ ID NO: 2217 - protein, 22 aa, Artificial Sequence
  Description of Artificial Sequence: Synthetic peptide
IPWCTLDPGSLQCAWLEERRSK

SEQ ID NO: 2218 - protein, 22 aa, Artificial Sequence
  Description of Artificial Sequence: Synthetic peptide
IPWCMLDPGSVQCLWLATQENG

SEQ ID NO: 2219 - protein, 16 aa, Artificial Sequence
  Description of Artificial Sequence: Synthetic peptide
IPWCSLDPGGLQCAWL

SEQ ID NO: 2220 - protein, 16 aa, Artificial Sequence
  Description of Artificial Sequence: Synthetic peptide
IPWCSLDPGSLQCAWM

SEQ ID NO: 2221 - protein, 22 aa, Artificial Sequence
  Description of Artificial Sequence: Synthetic peptide
IPWCTLDPGSLQCAWLSTQKVN

SEQ ID NO: 2222 - protein, 16 aa, Artificial Sequence
  Description of Artificial Sequence: Synthetic peptide
IPWCTLDPGSIQCAWM

SEQ ID NO: 2223 - protein, 16 aa, Artificial Sequence
  Description of Artificial Sequence: Synthetic peptide
IPWCMLDPGSIQCAWL

SEQ ID NO: 2224 - protein, 16 aa, Artificial Sequence
  Description of Artificial Sequence: Synthetic peptide
IPWCKLDPGSIQCVWL

SEQ ID NO: 2225 - protein, 16 aa, Artificial Sequence
  Description of Artificial Sequence: Synthetic peptide
IPWCKLDPGSLQCAYY

SEQ ID NO: 2226 - protein, 16 aa, Artificial Sequence
  Description of Artificial Sequence: Synthetic peptide
IPWCTLDPGSLQCAWV

SEQ ID NO: 2227 - protein, 16 aa, Artificial Sequence
  Description of Artificial Sequence: Synthetic peptide
IPWCTLDPGSLQCAWL

SEQ ID NO: 2228 - protein, 16 aa, Artificial Sequence
  Description of Artificial Sequence: Synthetic peptide
IPWCMLDPGSLQCAWM

SEQ ID NO: 2229 - protein, 16 aa, Artificial Sequence
  Description of Artificial Sequence: Synthetic peptide
IPWCTLDPGSFQCAWL

SEQ ID NO: 2230 - protein, 16 aa, Artificial Sequence
  Description of Artificial Sequence: Synthetic peptide
IPWCILDPGSVQCAFL

SEQ ID NO: 2231 - protein, 22 aa, Artificial Sequence
  Description of Artificial Sequence: Synthetic peptide
IPWCTLDPGSLQCAWLQKFGEG

SEQ ID NO: 2232 - protein, 22 aa, Artificial Sequence
  Description of Artificial Sequence: Synthetic peptide
IPWCALDPGSLQCAWLRSHGSE

SEQ ID NO: 2233 - protein, 16 aa, Artificial Sequence
  Description of Artificial Sequence: Synthetic peptide
IPWCTLDPGSLQCAYL

SEQ ID NO: 2234 - protein, 22 aa, Artificial Sequence
  Description of Artificial Sequence: Synthetic peptide
INWCLLDPGSLQCAWIRGDGHG

SEQ ID NO: 2235 - protein, 22 aa, Artificial Sequence
  Description of Artificial Sequence: Synthetic peptide
INWCLLDPGSLQCAWIRGDGHG

SEQ ID NO: 2236 - protein, 16 aa, Artificial Sequence
  Description of Artificial Sequence: Synthetic peptide
IPWCSLDPGSLQCAFY

SEQ ID NO: 2237 - protein, 22 aa, Artificial Sequence
  Description of Artificial Sequence: Synthetic peptide
IPWCTLDPGSIQCAFLQDMTSK

SEQ ID NO: 2238 - protein, 22 aa, Artificial Sequence
  Description of Artificial Sequence: Synthetic peptide
IPWCTLDPGSIQCAWLQRDPDL

SEQ ID NO: 2239 - protein, 22 aa, Artificial Sequence
  Description of Artificial Sequence: Synthetic peptide
IPWCTLDPGSIQCGWLKIQDKL

SEQ ID NO: 2240 - protein, 22 aa, Artificial Sequence
  Description of Artificial Sequence: Synthetic peptide
IPWCTLDPGSIQCVWVKEHLTR

SEQ ID NO: 2241 - protein, 22 aa, Artificial Sequence
  Description of Artificial Sequence: Synthetic peptide
IPWCLLDPGSLQCSYLKEAAEP

SEQ ID NO: 2242 - protein, 22 aa, Artificial Sequence
  Description of Artificial Sequence: Synthetic peptide
IPWCRLDPGSLQCLWQMRHAEN

SEQ ID NO: 2243 - protein, 22 aa, Artificial Sequence
  Description of Artificial Sequence: Synthetic peptide
IPWCTLDPGSLQCAFILGKTNS

SEQ ID NO: 2244 - protein, 22 aa, Artificial Sequence
  Description of Artificial Sequence: Synthetic peptide
IPWCALDPGSVQCAWLRRRGQR

SEQ ID NO: 2245 - protein, 22 aa, Artificial Sequence
  Description of Artificial Sequence: Synthetic peptide
IPWCLLDPGSVQCAYSKQGERA

SEQ ID NO: 2246 - protein, 22 aa, Artificial Sequence
  Description of Artificial Sequence: Synthetic peptide
IPWCTLDPGSVQCTWMKGQRAR

SEQ ID NO: 2247 - protein, 22 aa, Artificial Sequence
  Description of Artificial Sequence: Synthetic peptide
KAGSWFIPWCTLDPGSLQCAFL

SEQ ID NO: 2248 - protein, 22 aa, Artificial Sequence
  Description of Artificial Sequence: Synthetic peptide
KRRDSVIPWCLLDPGSLQCTWL

SEQ ID NO: 2249 - protein, 22 aa, Artificial Sequence
  Description of Artificial Sequence: Synthetic peptide
KRRIPWCSLDPGSLQCAYLERT

SEQ ID NO: 2250 - protein, 22 aa, Artificial Sequence
  Description of Artificial Sequence: Synthetic peptide
KTRIPWCTLDPGSIQCAWFMLY

SEQ ID NO: 2251 - protein, 22 aa, Artificial Sequence
  Description of Artificial Sequence: Synthetic peptide
LPWCTDHPGGQQCWWLEDREKR

SEQ ID NO: 2252 - protein, 22 aa, Artificial Sequence
  Description of Artificial Sequence: Synthetic peptide
LTSVPWCTLDPGSLQCAWLSRQ

SEQ ID NO: 2253 - protein, 22 aa, Artificial Sequence
  Description of Artificial Sequence: Synthetic peptide
MGGIPWCSLDPGSIQCAFLKKG

SEQ ID NO: 2254 - protein, 22 aa, Artificial Sequence
  Description of Artificial Sequence: Synthetic peptide
MQGGLGIPWCMLDPGSLQCLWL

SEQ ID NO: 2255 - protein, 22 aa, Artificial Sequence
  Description of Artificial Sequence: Synthetic peptide
METIPWCTLDPGSLQCHWITSS

SEQ ID NO: 2256 - protein, 22 aa, Artificial Sequence
  Description of Artificial Sequence: Synthetic peptide
MIHVPWCQLDPGGLQCAWLNDI

SEQ ID NO: 2257 - protein, 23 aa, Artificial Sequence
  Description of Artificial Sequence: Synthetic peptide
MCNSCFVPWCSLDPGSLQCAWLR

SEQ ID NO: 2258 - protein, 22 aa, Artificial Sequence
  Description of Artificial Sequence: Synthetic peptide
NPFRSVVPWCALDPGSLQCAWL

SEQ ID NO: 2259 - protein, 22 aa, Artificial Sequence
  Description of Artificial Sequence: Synthetic peptide
NRMIPWCELWPGSIQCAWITDL

SEQ ID NO: 2260 - protein, 22 aa, Artificial Sequence
  Description of Artificial Sequence: Synthetic peptide
NWSRSDVPWCTLDPGSIQCAFL

SEQ ID NO: 2261 - protein, 22 aa, Artificial Sequence
  Description of Artificial Sequence: Synthetic peptide
NQQVPWCSLDPGGLQCEWLKNR

SEQ ID NO: 2262 - protein, 22 aa, Artificial Sequence
  Description of Artificial Sequence: Synthetic peptide
QMQVPWCSLDPGSLQCAWMNNY

SEQ ID NO: 2263 - protein, 22 aa, Artificial Sequence
  Description of Artificial Sequence: Synthetic peptide
QWVVPWCMLDPGSLQCEWLKAN

SEQ ID NO: 2264 - protein, 22 aa, Artificial Sequence
  Description of Artificial Sequence: Synthetic peptide
QAGWRGDFWCSLDPGSQRCVRW

SEQ ID NO: 2265 - protein, 22 aa, Artificial Sequence
  Description of Artificial Sequence: Synthetic peptide
QNKVPWCLLDPGSLQCAWLRSN

SEQ ID NO: 2266 - protein, 22 aa, Artificial Sequence
  Description of Artificial Sequence: Synthetic peptide
QTVVPWCTLDPGSLQCAWLSRQ

SEQ ID NO: 2267 - protein, 22 aa, Artificial Sequence
  Description of Artificial Sequence: Synthetic peptide
QTLVPWCSLDPGSLQCTWLLKA

SEQ ID NO: 2268 - protein, 22 aa, Artificial Sequence
  Description of Artificial Sequence: Synthetic peptide
QHRIPWCALDPGGIQCAYLHRQ

SEQ ID NO: 2269 - protein, 22 aa, Artificial Sequence
  Description of Artificial Sequence: Synthetic peptide
RHFDDIIPWCTLDPGSLQCAYL

SEQ ID NO: 2270 - protein, 22 aa, Artificial Sequence
  Description of Artificial Sequence: Synthetic peptide
RVQMSFIPWCILDPGSLQCAWL

SEQ ID NO: 2271 - protein, 22 aa, Artificial Sequence
  Description of Artificial Sequence: Synthetic peptide
RDWTSGIPWCVLDPGSLQCQFL

SEQ ID NO: 2272 - protein, 22 aa, Artificial Sequence
  Description of Artificial Sequence: Synthetic peptide
RFSVTSVPWCLLDPGSLQCEFL

SEQ ID NO: 2273 - protein, 22 aa, Artificial Sequence
  Description of Artificial Sequence: Synthetic peptide
RSAVPWCTLDPGSIQCAYLRNQ

SEQ ID NO: 2274 - protein, 22 aa, Artificial Sequence
  Description of Artificial Sequence: Synthetic peptide
RWIDTVIPWCSLDPGGLQCLWL

SEQ ID NO: 2275 - protein, 22 aa, Artificial Sequence
  Description of Artificial Sequence: Synthetic peptide
RREIPWCTLDPGGLQCSWLRSI

SEQ ID NO: 2276 - protein, 22 aa, Artificial Sequence
  Description of Artificial Sequence: Synthetic peptide
RNPIPWCTLDPGGLQCAWLEEH

SEQ ID NO: 2277 - protein, 22 aa, Artificial Sequence
  Description of Artificial Sequence: Synthetic peptide
RNAIPWCDLDPGSLQCAYLRKH

SEQ ID NO: 2278 - protein, 17 aa, Artificial Sequence
  Description of Artificial Sequence: Synthetic peptide
RPVVCATLPGGYVCRVT

SEQ ID NO: 2279 - protein, 22 aa, Artificial Sequence
  Description of Artificial Sequence: Synthetic peptide
SLTVPWCTLDPGSMQCAWLQNR

SEQ ID NO: 2280 - protein, 22 aa, Artificial Sequence
  Description of Artificial Sequence: Synthetic peptide
SGKWGDIPWCTLDPGSIQCAWL

SEQ ID NO: 2281 - protein, 22 aa, Artificial Sequence
  Description of Artificial Sequence: Synthetic peptide
SEMGESIPWCQLDPGSVQCAWL

SEQ ID NO: 2282 - protein, 22 aa, Artificial Sequence
  Description of Artificial Sequence: Synthetic peptide
SNIVPWCTLDPGGLQCAWIMGR

SEQ ID NO: 2283 - protein, 22 aa, Artificial Sequence
  Description of Artificial Sequence: Synthetic peptide
SRRIPWCTLDPGSLQCAWLRHQ

SEQ ID NO: 2284 - protein, 22 aa, Artificial Sequence
  Description of Artificial Sequence: Synthetic peptide
STNHGQIPWCTLDPGSLQCTWL

SEQ ID NO: 2285 - protein, 22 aa, Artificial Sequence
  Description of Artificial Sequence: Synthetic peptide
SWSVPWCTLDPGSMQCVWLQMQ

SEQ ID NO: 2286 - protein, 22 aa, Artificial Sequence
  Description of Artificial Sequence: Synthetic peptide
TTEIQDIPWCELDPGSLQCAYM

SEQ ID NO: 2287 - protein, 22 aa, Artificial Sequence
  Description of Artificial Sequence: Synthetic peptide
TSRVPGCSLDPGSLQCAWLRHF

SEQ ID NO: 2288 - protein, 16 aa, Artificial Sequence
  Description of Artificial Sequence: Synthetic peptide
VPWCMLDPGSMQCAWL

SEQ ID NO: 2289 - protein, 22 aa, Artificial Sequence
  Description of Artificial Sequence: Synthetic peptide
VDWCILDPGSLQCSWLKNMWNK

SEQ ID NO: 2290 - protein, 22 aa, Artificial Sequence
  Description of Artificial Sequence: Synthetic peptide
VPWCELDPGGLQCSYLRGWVTD

SEQ ID NO: 2291 - protein, 21 aa, Artificial Sequence
  Description of Artificial Sequence: Synthetic peptide
VLETQVPWCTLDPGSIQCAWL

SEQ ID NO: 2292 - protein, 22 aa, Artificial Sequence
  Description of Artificial Sequence: Synthetic peptide
VPWCILDPGSVQCAWLRDNQVW

SEQ ID NO: 2293 - protein, 16 aa, Artificial Sequence
  Description of Artificial Sequence: Synthetic peptide
VPWCTLDPGSYQCAWL

SEQ ID NO: 2294 - protein, 22 aa, Artificial Sequence
  Description of Artificial Sequence: Synthetic peptide
VGSTMRIPWCSLDPGSLQCEYL

SEQ ID NO: 2295 - protein, 22 aa, Artificial Sequence
  Description of Artificial Sequence: Synthetic peptide
VHRIPWCTLDPGGLQCAWLRQM

SEQ ID NO: 2296 - protein, 16 aa, Artificial Sequence
  Description of Artificial Sequence: Synthetic peptide
VPWCTLDPGSLQCKWL

SEQ ID NO: 2297 - protein, 22 aa, Artificial Sequence
  Description of Artificial Sequence: Synthetic peptide
VPWCRLDPGSIQCAYLRSEQKS

SEQ ID NO: 2298 - protein, 22 aa, Artificial Sequence
  Description of Artificial Sequence: Synthetic peptide
VAGVPWCSLDPGSLQCHWLNEH

SEQ ID NO: 2299 - protein, 22 aa, Artificial Sequence
  Description of Artificial Sequence: Synthetic peptide
VPWCTLDPGSIQCAYLKNQVDG

SEQ ID NO: 2300 - protein, 22 aa, Artificial Sequence
  Description of Artificial Sequence: Synthetic peptide
VRYVPWCTLDPGSIQCAYLQEQ

SEQ ID NO: 2301 - protein, 22 aa, Artificial Sequence
  Description of Artificial Sequence: Synthetic peptide
VPWCNLDPGGLQCEWLTRVLGR

SEQ ID NO: 2302 - protein, 22 aa, Artificial Sequence
  Description of Artificial Sequence: Synthetic peptide
VPWCMLDPGSLQCSWLQQTFSN

SEQ ID NO: 2303 - protein, 16 aa, Artificial Sequence
  Description of Artificial Sequence: Synthetic peptide
VPWCTLDPGGIQCAWL

SEQ ID NO: 2304 - protein, 16 aa, Artificial Sequence
  Description of Artificial Sequence: Synthetic peptide
VPWCTLDPGSIQCHWL

SEQ ID NO: 2305 - protein, 16 aa, Artificial Sequence
  Description of Artificial Sequence: Synthetic peptide
VPWCTLDPGSFQCAWL

SEQ ID NO: 2306 - protein, 22 aa, Artificial Sequence
  Description of Artificial Sequence: Synthetic peptide
VPWCLLDPGSVQCAFLNRQKED

SEQ ID NO: 2307 - protein, 16 aa, Artificial Sequence
  Description of Artificial Sequence: Synthetic peptide
VPWCMLDPGSLQCMYL

SEQ ID NO: 2308 - protein, 16 aa, Artificial Sequence
  Description of Artificial Sequence: Synthetic peptide
VPWCMLDPGSIQCAFL

SEQ ID NO: 2309 - protein, 22 aa, Artificial Sequence
  Description of Artificial Sequence: Synthetic peptide
VPWCTLDPGGLQCAWMRGTYSQ

SEQ ID NO: 2310 - protein, 22 aa, Artificial Sequence
  Description of Artificial Sequence: Synthetic peptide
VPWCRLDPGSVQCAWLRSRNNV

SEQ ID NO: 2311 - protein, 16 aa, Artificial Sequence
  Description of Artificial Sequence: Synthetic peptide
VPWCALDPGSVQCAFL

SEQ ID NO: 2312 - protein, 16 aa, Artificial Sequence
  Description of Artificial Sequence: Synthetic peptide
VPWCMLDPGSLQCMYL

SEQ ID NO: 2313 - protein, 16 aa, Artificial Sequence
  Description of Artificial Sequence: Synthetic peptide
VPWCTLDPGSLQCAWF

SEQ ID NO: 2314 - protein, 16 aa, Artificial Sequence
  Description of Artificial Sequence: Synthetic peptide
VPWCILDPGSLQCAYL

SEQ ID NO: 2315 - protein, 16 aa, Artificial Sequence
  Description of Artificial Sequence: Synthetic peptide
VPWCHLDPGGIQCAYL

SEQ ID NO: 2316 - protein, 22 aa, Artificial Sequence
  Description of Artificial Sequence: Synthetic peptide
VPWCSLDPGSLQCHWQVSRGWH

SEQ ID NO: 2317 - protein, 22 aa, Artificial Sequence
  Description of Artificial Sequence: Synthetic peptide
VPWCELDPGSLQCAWLQTWGVN

SEQ ID NO: 2318 - protein, 22 aa, Artificial Sequence
  Description of Artificial Sequence: Synthetic peptide
VPWCKIDPGSLQCAYLKRHQIL

SEQ ID NO: 2319 - protein, 22 aa, Artificial Sequence
  Description of Artificial Sequence: Synthetic peptide
VPWCKLDPGSFQCAFLRELERQ

SEQ ID NO: 2320 - protein, 22 aa, Artificial Sequence
  Description of Artificial Sequence: Synthetic peptide
VPWCLLDPGSLQCAWLKRMEVD

SEQ ID NO: 2321 - protein, 22 aa, Artificial Sequence
  Description of Artificial Sequence: Synthetic peptide
VPWCLLDPGSLQCAWMRSGEGK

SEQ ID NO: 2322 - protein, 22 aa, Artificial Sequence
  Description of Artificial Sequence: Synthetic peptide
VPWCLLDPGSLQCAYLEGKWDL

SEQ ID NO: 2323 - protein, 22 aa, Artificial Sequence
  Description of Artificial Sequence: Synthetic peptide
VPWCMLDPGSIQCAWINEQNML

SEQ ID NO: 2324 - protein, 22 aa, Artificial Sequence
  Description of Artificial Sequence: Synthetic peptide
VPWCMLDPGSLQCAWMRSQREE

SEQ ID NO: 2325 - protein, 22 aa, Artificial Sequence
  Description of Artificial Sequence: Synthetic peptide
VPWCTIDPGSLQCTWLRVHRGE

SEQ ID NO: 2326 - protein, 22 aa, Artificial Sequence
  Description of Artificial Sequence: Synthetic peptide
VPWCTLDPGSLQCAWLEKESRT

SEQ ID NO: 2327 - protein, 22 aa, Artificial Sequence
  Description of Artificial Sequence: Synthetic peptide
VPWCTLDPGSLQCAWLISNARE

SEQ ID NO: 2328 - protein, 22 aa, Artificial Sequence
  Description of Artificial Sequence: Synthetic peptide
VPWCTLDPGSLQCAWLKIQEAL

SEQ ID NO: 2329 - protein, 22 aa, Artificial Sequence
  Description of Artificial Sequence: Synthetic peptide
VPWCTLDPGSLQCAWLKKHEGG

SEQ ID NO: 2330 - protein, 22 aa, Artificial Sequence
  Description of Artificial Sequence: Synthetic peptide
VPWCTLDPGSLQCAWLNNHRSR

SEQ ID NO: 2331 - protein, 22 aa, Artificial Sequence
  Description of Artificial Sequence: Synthetic peptide
VPWCTLDPGSLQCDWLMKRRNT

SEQ ID NO: 2332 - protein, 22 aa, Artificial Sequence
  Description of Artificial Sequence: Synthetic peptide
VPWCTLDPGSLQCDYLKWMNMR

SEQ ID NO: 2333 - protein, 22 aa, Artificial Sequence
  Description of Artificial Sequence: Synthetic peptide
VPWCTLDPGSLQCHWLLSRSDN

SEQ ID NO: 2334 - protein, 22 aa, Artificial Sequence
  Description of Artificial Sequence: Synthetic peptide
VPWCTLDPGSVQCAYLKARRPS

SEQ ID NO: 2335 - protein, 22 aa, Artificial Sequence
  Description of Artificial Sequence: Synthetic peptide
VPWCVLDPGSIQCEYLQRLHRQ

SEQ ID NO: 2336 - protein, 22 aa, Artificial Sequence
  Description of Artificial Sequence: Synthetic peptide
WRRVPWCTLDPGSLQCAWLNSH

SEQ ID NO: 2337 - protein, 21 aa, Artificial Sequence
  Description of Artificial Sequence: Synthetic peptide
WGIPWCTLDPGSLQCAWLGKH

SEQ ID NO: 2338 - protein, 22 aa, Artificial Sequence
  Description of Artificial Sequence: Synthetic peptide
WTQIPWCTLDPGSIQCSWLSRE

SEQ ID NO: 2339 - protein, 22 aa, Artificial Sequence
  Description of Artificial Sequence: Synthetic peptide
WVTIPWCILDPGSLQCEWQTKV

SEQ ID NO: 2340 - protein, 22 aa, Artificial Sequence
  Description of Artificial Sequence: Synthetic peptide
WTQVPWCTLDPGSLQCDWLSKR

SEQ ID NO: 2341 - protein, 22 aa, Artificial Sequence
  Description of Artificial Sequence: Synthetic peptide
WERDSEIPWCTLDPGSLQCAWL

SEQ ID NO: 2342 - protein, 22 aa, Artificial Sequence
  Description of Artificial Sequence: Synthetic peptide
WFEIPWCTLDPGSLQCEWSMQN

SEQ ID NO: 2343 - protein, 22 aa, Artificial Sequence
  Description of Artificial Sequence: Synthetic peptide
WRQTLQIPWCSLDPGSLQCAYL

SEQ ID NO: 2344 - protein, 22 aa, Artificial Sequence
  Description of Artificial Sequence: Synthetic peptide
YSGRREIPWCTLDPGSLQCTWL

SEQ ID NO: 2345 - protein, 22 aa, Artificial Sequence
  Description of Artificial Sequence: Synthetic peptide
YRSGHGIPWCMLDPGGLQCSWL

SEQ ID NO: 2346 - protein, 22 aa, Artificial Sequence
  Description of Artificial Sequence: Synthetic peptide
YKGVSEIPWCVLDPGSVQCAYL

SEQ ID NO: 2347 - protein, 22 aa, Artificial Sequence
  Description of Artificial Sequence: Synthetic peptide
YKYIPWCTLDPGSLQCAWLARN

SEQ ID NO: 2348 - protein, 22 aa, Artificial Sequence
  Description of Artificial Sequence: Synthetic peptide
YQPVPWCTLDPGSLQCAWLSNI

SEQ ID NO: 2349 - protein, 22 aa, Artificial Sequence
  Description of Artificial Sequence: Synthetic peptide
YNFVPWCMLDPGSLQCAYLRKT

SEQ ID NO: 2350 - protein, 22 aa, Artificial Sequence
  Description of Artificial Sequence: Synthetic peptide
  MOD_RES (1)..(1): Any amino acid
  MOD_RES (2)..(2): Any amino acid
  MOD_RES (3)..(3): Any amino acid
  MOD_RES (4)..(4): Any amino acid comprising a basic side chain
  MOD_RES (5)..(5): Any amino acid comprising a large hydrophobic side chain
  MOD_RES (6)..(6): Any amino acid comprising an acidic side chain or any amino acid comprising a large hydrophobic side chain
  MOD_RES (8)..(8): Any amino acid comprising a small hydrophobic side chain
  MOD_RES (9)..(9): Any amino acid comprising an acidic side chain
  MOD_RES (10)..(10): Any amino acid comprising a large hydrophobic side chain
  MOD_RES (11)..(11): Any amino acid comprising a small hydrophobic side chain
  MOD_RES (12)..(12): Any amino acid comprising a small hydrophobic side chain
  MOD_RES (13)..(13): Any amino acid comprising a small hydrophobic side chain
  MOD_RES (14)..(14): Any amino acid comprising a basic side chain or any amino acid comprising a large hydrophobic side chain
  MOD_RES (15)..(15): Any amino acid comprising a polar/neutral side chain or a large hydrophobic side chain
  MOD_RES (17)..(17): Any amino acid comprising a basic side chain
  MOD_RES (18)..(18): Any amino acid comprising a large hydrophobic side chain
  MOD_RES (19)..(19): Any amino acid comprising a basic side chain
  MOD_RES (20)..(20): Any amino acid
  MOD_RES (21)..(21): Any amino acid
  MOD_RES (22)..(22): Any amino acid
XXXXXXCXXXXXXXXCXXXXXX

SEQ ID NO: 2351 - protein, 16 aa, Artificial Sequence
  Description of Artificial Sequence: Synthetic peptide
  MOD_RES (1)..(1): Any amino acid comprising a basic side chain
  MOD_RES (2)..(2): Any amino acid comprising a large hydrophobic side chain
  MOD_RES (3)..(3): Any amino acid comprising an acidic side chain or any amino acid comprising a large hydrophobic side chain
  MOD_RES (5)..(5): Any amino acid comprising a small hydrophobic side chain
  MOD_RES (6)..(6): Any amino acid comprising an acidic side chain
  MOD_RES (7)..(7): Any amino acid comprising a large hydrophobic side chain
  MOD_RES (8)..(8): Any amino acid comprising a small hydrophobic side chain
  MOD_RES (9)..(9): Any amino acid comprising a small hydrophobic side chain
  MOD_RES (10)..(10): Any amino acid comprising a small hydrophobic side chain
  MOD_RES (11)..(11): Any amino acid comprising a basic side chain or any amino acid comprising a large hydrophobic side chain
  MOD_RES (12)..(12): Any amino acid comprising a polar/neutral side chain or a large hydrophobic side chain
  MOD_RES (14)..(14): Any amino acid comprising a basic side chain
  MOD_RES (15)..(15): Any amino acid comprising a large hydrophobic side chain
  MOD_RES (16)..(16): Any amino acid comprising a basic side chain
XXXCXXXXXXXXCXXX

SEQ ID NO: 2352 - protein, 14 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising an acidic side chain or any amino acid comprising a large hydrophobic side chain
  MOD_RES (4)..(4): Any amino acid comprising a small hydrophobic side chain
  MOD_RES (5)..(5): Any amino acid comprising an acidic side chain
  MOD_RES (6)..(6): Any amino acid comprising a large hydrophobic side chain
  MOD_RES (7)..(7): Any amino acid comprising a small hydrophobic side chain
  MOD_RES (8)..(8): Any amino acid comprising a small hydrophobic side chain
  MOD_RES (9)..(9): Any amino acid comprising a small hydrophobic side chain
  MOD_RES (10)..(10): Any amino acid comprising a basic side chain or any amino acid comprising a large hydrophobic side chain
  MOD_RES (11)..(11): Any amino acid comprising a polar/neutral side chain or a large hydrophobic side chain
  MOD_RES (13)..(13): Any amino acid comprising a basic side chain
  MOD_RES (14)..(14): Any amino acid comprising a large hydrophobic side chain
XXCXXXXXXXXCXX

SEQ ID NO: 2353 - protein, 12 aa, Artificial Sequence
  Description of Artificial Sequence: Synthetic peptide
  MOD_RES (1)..(1): Any amino acid comprising an acidic side chain or any amino acid comprising a large hydrophobic side chain
  MOD_RES (3)..(3): Any amino acid comprising a small hydrophobic side chain
  MOD_RES (4)..(4): Any amino acid comprising an acidic side chain
  MOD_RES (5)..(5): Any amino acid comprising a large hydrophobic side chain
  MOD_RES (6)..(6): Any amino acid comprising a small hydrophobic side chain
  MOD_RES (7)..(7): Any amino acid comprising a small hydrophobic side chain
  MOD_RES (8)..(8): Any amino acid comprising a small hydrophobic side chain
  MOD_RES (9)..(9): Any amino acid comprising a basic side chain or any amino acid comprising a large hydrophobic side chain
  MOD_RES (10)..(10): Any amino acid comprising a polar/neutral side chain or a large hydrophobic side chain
  MOD_RES (12)..(12): Any amino acid comprising a basic side chain
XCXXXXXXXXCX

SEQ ID NO: 2354 - protein, 10 aa, Artificial Sequence
  Description of Artificial Sequence: Synthetic peptide
  MOD_RES (2)..(2): Any amino acid comprising a small hydrophobic side chain
  MOD_RES (3)..(3): Any amino acid comprising an acidic side chain
  MOD_RES (4)..(4): Any amino acid comprising a large hydrophobic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid comprising a small hydrophobic side chain
  MOD_RES (8)..(8): Any amino acid comprising a basic side chain or any amino acid comprising a large hydrophobic side chain
  MOD_RES (9)..(9): Any amino acid comprising a polar/neutral side chain or a large hydrophobic side chain
CXXXXXXXXC

SEQ ID NO: 2355 - protein, 8 aa, Artificial Sequence
  Description of Artificial Sequence: Synthetic peptide
  MOD_RES (1)..(1): Any amino acid comprising a small hydrophobic side chain
  MOD_RES (2)..(2): Any amino acid comprising an acidic side chain
  MOD_RES (3)..(3): Any amino acid comprising a large hydrophobic side chain
  MOD_RES (4)..(4): Any amino acid comprising a small hydrophobic side chain
  MOD_RES (5)..(5): Any amino acid comprising a small hydrophobic side chain
  MOD_RES (6)..(6): Any amino acid comprising a small hydrophobic side chain
  MOD_RES (7)..(7): Any amino acid comprising a basic side chain or any amino acid comprising a large hydrophobic side chain
  MOD_RES (8)..(8): Any amino acid comprising a polar/neutral side chain or a large hydrophobic side chain
XXXXXXXX

SEQ ID NO: 2356 - protein, 20 aa, Artificial Sequence
  Description of Artificial Sequence: Synthetic peptide
FRLECADLPGGRNCRLRTSG

SEQ ID NO: 2357 - protein, 16 aa, Artificial Sequence
  Description of Artificial Sequence: Synthetic peptide
ILECAELPGGRHCRLR

SEQ ID NO: 2358 - protein, 22 aa, Artificial Sequence
  Description of Artificial Sequence: Synthetic peptide
KGVRLYCADLPGGRICRSGKVE

SEQ ID NO: 2359 - protein, 22 aa, Artificial Sequence
  Description of Artificial Sequence: Synthetic peptide
LRLLQYCADLPGGFNCRVREDL

SEQ ID NO: 2360 - protein, 16 aa, Artificial Sequence
  Description of Artificial Sequence: Synthetic peptide
PVECAEFPGGRVCRLR

SEQ ID NO: 2361 - protein, 16 aa, Artificial Sequence
  Description of Artificial Sequence: Synthetic peptide
QIDCADLPGGHVCRLR

SEQ ID NO: 2362 - protein, 16 aa, Artificial Sequence
  Description of Artificial Sequence: Synthetic peptide
RVECAQLPGGKVCRLR

SEQ ID NO: 2363 - protein, 22 aa, Artificial Sequence
  Description of Artificial Sequence: Synthetic peptide
RGCRLDCADLPGGHTCRCRSAD

SEQ ID NO: 2364 - protein, 16 aa, Artificial Sequence
  Description of Artificial Sequence: Synthetic peptide
RIECADLPGGHVCRLR

SEQ ID NO: 2365 - protein, 22 aa, Artificial Sequence
  Description of Artificial Sequence: Synthetic peptide
RKMHLECADLPGGRHCRLRHEM

SEQ ID NO: 2366 - protein, 22 aa, Artificial Sequence
  Description of Artificial Sequence: Synthetic peptide
RNGRIECADLPGGFVCRMRDMD

SEQ ID NO: 2367 - protein, 22 aa, Artificial Sequence
  Description of Artificial Sequence: Synthetic peptide
RDVRLECADLPGGHVCRLRDSR

SEQ ID NO: 2368 - protein, 22 aa, Artificial Sequence
  Description of Artificial Sequence: Synthetic peptide
RKARIDCAELPGGRQCRLHGWS

SEQ ID NO: 2369 - protein, 16 aa, Artificial Sequence
  Description of Artificial Sequence: Synthetic peptide
RVECAQLPGGKVCRMR

SEQ ID NO: 2370 - protein, 16 aa, Artificial Sequence
  Description of Artificial Sequence: Synthetic peptide
RVECAELPGGFVCRLR

SEQ ID NO: 2371 - protein, 16 aa, Artificial Sequence
  Description of Artificial Sequence: Synthetic peptide
RVYCADLPGGRQCRSH

SEQ ID NO: 2372 - protein, 16 aa, Artificial Sequence
  Description of Artificial Sequence: Synthetic peptide
RIYCAELPGGQVCRSR

SEQ ID NO: 2373 - protein, 22 aa, Artificial Sequence
  Description of Artificial Sequence: Synthetic peptide
RREPVYCADLPGGLHCRVRVSE

SEQ ID NO: 2374 - protein, 16 aa, Artificial Sequence
  Description of Artificial Sequence: Synthetic peptide
RLECADLPGGRACRLR

SEQ ID NO: 2375 - protein, 16 aa, Artificial Sequence
  Description of Artificial Sequence: Synthetic peptide
RVYCADLPGGRQCRSH

SEQ ID NO: 2376 - protein, 16 aa, Artificial Sequence
  Description of Artificial Sequence: Synthetic peptide
RVYCAELPGGLACRGR

SEQ ID NO: 2377 - protein, 22 aa, Artificial Sequence
  Description of Artificial Sequence: Synthetic peptide
RNGRVYCADLPGGRQCRSWGAI

SEQ ID NO: 2378 - protein, 16 aa, Artificial Sequence
  Description of Artificial Sequence: Synthetic peptide
RLECANLPGGFNCRLR

SEQ ID NO: 2379 - protein, 16 aa, Artificial Sequence
  Description of Artificial Sequence: Synthetic peptide
RLECADLPGGRHCRLR

SEQ ID NO: 2380 - protein, 16 aa, Artificial Sequence
  Description of Artificial Sequence: Synthetic peptide
RLECAKLPGGFNCRLR

SEQ ID NO: 2381 - protein, 16 aa, Artificial Sequence
  Description of Artificial Sequence: Synthetic peptide
RIECAELPGGFTCRLR

SEQ ID NO: 2382 - protein, 16 aa, Artificial Sequence
  Description of Artificial Sequence: Synthetic peptide
RIYCESLPGGFNCRLR

SEQ ID NO: 2383 - protein, 16 aa, Artificial Sequence
  Description of Artificial Sequence: Synthetic peptide
RVYCAELPGGLACRLR

SEQ ID NO: 2384 - protein, 16 aa, Artificial Sequence
  Description of Artificial Sequence: Synthetic peptide
RYECADLPGGLHCEFR

SEQ ID NO: 2385 - protein, 16 aa, Artificial Sequence
  Description of Artificial Sequence: Synthetic peptide
RVECAELPGGFHCRLR

SEQ ID NO: 2386 - protein, 16 aa, Artificial Sequence
  Description of Artificial Sequence: Synthetic peptide
RVECADLPGGRVCKSR

SEQ ID NO: 2387 - protein, 16 aa, Artificial Sequence
  Description of Artificial Sequence: Synthetic peptide
RVECADLPGGLACRLR

SEQ ID NO: 2388 - protein, 22 aa, Artificial Sequence
  Description of Artificial Sequence: Synthetic peptide
TFRRVYCQELPGGLVCRAHSQD

SEQ ID NO: 2389 - protein, 16 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a small hydrophobic side chain or cysteine
  MOD_RES (3)..(3): Any amino acid comprising a large hydrophobic side chain
  MOD_RES (4)..(4): Any amino acid comprising a basic side chain or cysteine
  MOD_RES (5)..(5): Any amino acid comprising a large hydrophobic side chain or any amino acid comprising small hydrophobic side chain
  MOD_RES (6)..(6): Any amino acid comprising a large hydrophobic side chain or any amino acid comprising an acidic side chain
  MOD_RES (7)..(7): Any amino acid comprising an acidic side chain
  MOD_RES (8)..(8): Any amino acid comprising an acidic side chain or any amino acid comprising a small hydrophobic side chain
  MOD_RES (9)..(9): Any amino acid comprising a small hydrophobic side chain
  MOD_RES (10)..(10): Any amino acid comprising a large hydrophobic side chain or any amino acid comprising a small hydrophobic side chain
  MOD_RES (11)..(11): Any amino acid comprising a large hydrophobic side chain
  MOD_RES (12)..(12): Any amino acid comprising a polar/neutral side chain
  MOD_RES (14)..(14): Any amino acid comprising a small hydrophobic side chain or any amino acid comprising a large hydrophobic side chain
  MOD_RES (15)..(15): Any amino acid comprising a large hydrophobic side chain
  MOD_RES (16)..(16): Any amino acid comprising a large hydrophobic side chain
XXXXXXXXXXXXCXXX

SEQ ID NO: 2390 - protein, 14 aa, Artificial Sequence
  Description of Artificial Sequence: Synthetic peptide
  MOD_RES (1)..(1): Any amino acid comprising a small hydrophobic side chain or cysteine
  MOD_RES (2)..(2): Any amino acid comprising a large hydrophobic side chain
  MOD_RES (3)..(3): Any amino acid comprising a basic side chain or cysteine
  MOD_RES (4)..(4): Any amino acid comprising a large hydrophobic side chain or any amino acid comprising small hydrophobic side chain
  MOD_RES (5)..(5): Any amino acid comprising a large hydrophobic side chain or any amino acid comprising an acidic side chain
  MOD_RES (6)..(6): Any amino acid comprising an acidic side chain
  MOD_RES (7)..(7): Any amino acid comprising an acidic side chain or any amino acid comprising a small hydrophobic side chain
  MOD_RES (8)..(8): Any amino acid comprising a small hydrophobic side chain
  MOD_RES (9)..(9): Any amino acid comprising a large hydrophobic side chain or any amino acid comprising a small hydrophobic side chain
  MOD_RES (10)..(10): Any amino acid comprising a large hydrophobic side chain
  MOD_RES (11)..(11): Any amino acid comprising a polar/neutral side chain
  MOD_RES (13)..(13): Any amino acid comprising a small hydrophobic side chain or any amino acid comprising a large hydrophobic side chain
  MOD_RES (14)..(14): Any amino acid comprising a large hydrophobic side chain
XXXXXXXXXXXCXX

SEQ ID NO: 2391 - protein, 12 aa, Artificial Sequence
  Description of Artificial Sequence: Synthetic peptide
  MOD_RES (1)..(1): Any amino acid comprising a large hydrophobic side chain
  MOD_RES (2)..(2): Any amino acid comprising a basic side chain or cysteine
  MOD_RES (3)..(3): Any amino acid comprising a large hydrophobic side chain or any amino acid comprising small hydrophobic side chain
  MOD_RES (4)..(4): Any amino acid comprising a large hydrophobic side chain or any amino acid comprising an acidic side chain
  MOD_RES (5)..(5): Any amino acid comprising an acidic side chain
  MOD_RES (6)..(6): Any amino acid comprising an acidic side chain or any amino acid comprising a small hydrophobic side chain
  MOD_RES (7)..(7): Any amino acid comprising a small hydrophobic side chain
  MOD_RES (8)..(8): Any amino acid comprising a large hydrophobic side chain or any amino acid comprising a small hydrophobic side chain
  MOD_RES (9)..(9): Any amino acid comprising a large hydrophobic side chain
  MOD_RES (10)..(10): Any amino acid comprising a polar/neutral side chain
  MOD_RES (12)..(12): Any amino acid comprising a small hydrophobic side chain or any amino acid comprising a large hydrophobic side chain
XXXXXXXXXXCX

SEQ ID NO: 2392 - protein, 10 aa, Artificial Sequence
  Description of Artificial Sequence: Synthetic peptide
  MOD_RES (1)..(1): Any amino acid comprising a basic side chain or cysteine
  MOD_RES (2)..(2): Any amino acid comprising a large hydrophobic side chain or any amino acid comprising small hydrophobic side chain
  MOD_RES (3)..(3): Any amino acid comprising a large hydrophobic side chain or any amino acid comprising an acidic side chain
  MOD_RES (4)..(4): Any amino acid comprising an acidic side chain
  MOD_RES (5)..(5): Any amino acid comprising an acidic side chain or any amino acid comprising a small hydrophobic side chain
  MOD_RES (6)..(6): Any amino acid comprising a small hydrophobic side chain
  MOD_RES (7)..(7): Any amino acid comprising a large hydrophobic side chain or any amino acid comprising a small hydrophobic side chain
  MOD_RES (8)..(8): Any amino acid comprising a large hydrophobic side chain
  MOD_RES (9)..(9): Any amino acid comprising a polar/neutral side chain
XXXXXXXXXC

SEQ ID NO: 2393 - protein, 20 aa, Artificial Sequence
  Description of Artificial Sequence: Synthetic peptide
HCLHWDIETLMSCVYGNFEE

SEQ ID NO: 2394 - protein, 14 aa, Artificial Sequence
  Description of Artificial Sequence: Synthetic peptide
HCKHWDLESLLLCV

SEQ ID NO: 2395 - protein, 22 aa, Artificial Sequence
  Description of Artificial Sequence: Synthetic peptide
HLGVPWCTLDPGSIQCAWLAKH

SEQ ID NO: 2396 - protein, 22 aa, Artificial Sequence
  Description of Artificial Sequence: Synthetic peptide
IRSCLWQPGALHCTWWAEEEPV

SEQ ID NO: 2397 - protein, 16 aa, Artificial Sequence
  Description of Artificial Sequence: Synthetic peptide
IPWCLLDPGGLQCVWL

SEQ ID NO: 2398 - protein, 22 aa, Artificial Sequence
  Description of Artificial Sequence: Synthetic peptide
KAGSWFIPWCTLDPGSLQCAFL

SEQ ID NO: 2399 - protein, 22 aa, Artificial Sequence
  Description of Artificial Sequence: Synthetic peptide
NPFRSVVPWCALDPGSLQCAWL

SEQ ID NO: 2400 - protein, 14 aa, Artificial Sequence
  Description of Artificial Sequence: Synthetic peptide
QCIHWDIETLLSCV

SEQ ID NO: 2401 - protein, 20 aa, Artificial Sequence
  Description of Artificial Sequence: Synthetic peptide
QCIHWDLESLLNCLRELKEP

SEQ ID NO: 2402 - protein, 20 aa, Artificial Sequence
  Description of Artificial Sequence: Synthetic peptide
QCVHWDLDTLFGCIREQLEL

SEQ ID NO: 2403 - protein, 22 aa, Artificial Sequence
  Description of Artificial Sequence: Synthetic peptide
RHFDDIIPWCTLDPGSLQCAYL

SEQ ID NO: 2404 - protein, 20 aa, Artificial Sequence
  Description of Artificial Sequence: Synthetic peptide
SAKVLKQCLHWDLESLLSCL

SEQ ID NO: 2405 - protein, 22 aa, Artificial Sequence
  Description of Artificial Sequence: Synthetic peptide
SLTVPWCTLDPGSMQCAWLQNR

SEQ ID NO: 2406 - protein, 16 aa, Artificial Sequence
  Description of Artificial Sequence: Synthetic peptide
VPWCMLDPGSMQCAWL

SEQ ID NO: 2407 - protein, 22 aa, Artificial Sequence
  Description of Artificial Sequence: Synthetic peptide
VHRIPWCTLDPGGLQCAWLRQM

SEQ ID NO: 2408 - protein, 22 aa, Artificial Sequence
  Description of Artificial Sequence: Synthetic peptide
WVTIPWCILDPGSLQCEWQTKV

SEQ ID NO: 2409 - protein, 21 aa, Artificial Sequence
  Description of Artificial Sequence: Synthetic peptide
WGIPWCTLDPGSLQCAWLGKH

SEQ ID NO: 2410 - protein, 22 aa, Artificial Sequence
  Description of Artificial Sequence: Synthetic peptide
YRSGHGIPWCMLDPGGLQCSWL

SEQ ID NO: 2411-2600 - skipped (190 entries)

SEQ ID NO: 2601 - protein, 26 aa, Artificial Sequence
  Description of Artificial Sequence: Synthetic peptide
GGHLGVPWCTLDPGSIQCAWLAKHGG

SEQ ID NO: 2602 - protein, 22 aa, Artificial Sequence
  Description of Artificial Sequence: Synthetic peptide
QCVHWDLDTLFGCIREQLELGG

SEQ ID NO: 2603-4000 - skipped (1398 entries)

SEQ ID NO: 4001 - protein, 37 aa, Artificial Sequence
  Description of Artificial Sequence: Synthetic polypeptide
WYPCWMAQLGELCDLDGGGGSGGVVCQDWEGVELCWQ

SEQ ID NO: 4002 - protein, 39 aa, Artificial Sequence
  Description of Artificial Sequence: Synthetic polypeptide
GWYPCWMAQLGELCDLDGGGGSGGVVCQDWEGVELCWQG

SEQ ID NO: 4003 - protein, 40 aa, Artificial Sequence
  Description of Artificial Sequence: Synthetic polypeptide
GGWYPCWMAQLGELCDLDGGGGSGGVVCQDWEGVELCWQG

SEQ ID NO: 4004 - protein, 40 aa, Artificial Sequence
  Description of Artificial Sequence: Synthetic polypeptide
GWYPCWMAQLGELCDLDGGGGSGGVVCQDWEGVELCWQGG

SEQ ID NO: 4005 - protein, 41 aa, Artificial Sequence
  Description of Artificial Sequence: Synthetic polypeptide
GGWYPCWMAQLGELCDLDGGGGSGGVVCQDWEGVELCWQGG

SEQ ID NO: 4006 - protein, 50 aa, Artificial Sequence
  Description of Artificial Sequence: Synthetic polypeptide
  MOD_RES (17)..(36): Any amino acid
  MISC_FEATURE (17)..(36): This region may encompass 1-20 residues
WYPCWMAQLGELCDLDXXXXXXXXXXXXXXXXXXXXVVCQDWEGVELCWQ

SEQ ID NO: 4007 - protein, 70 aa, Artificial Sequence
  Description of Artificial Sequence: Synthetic polypeptide
  MOD_RES (1)..(10): Any amino acid
  MISC_FEATURE (1)..(10): This region may encompass 1-10 residues or be absent in its entirety
  MOD_RES (27)..(46): Any amino acid
  MISC_FEATURE (27)..(46): This region may encompass 1-20 residues
  MOD_RES (61)..(70): Any amino acid
  MISC_FEATURE (61)..(70): This region may encompass 1-10 residues or be absent in its entirety
XXXXXXXXXXWYPCWMAQLGELCDLDXXXXXXXXXXXXXXXXXXXXVVCQDWEGVELCWQXXXXXXXXXX

SEQ ID NO: 4008-4020 - skipped (13 entries)

SEQ ID NO: 4021 - protein, 43 aa, Artificial Sequence
  Description of Artificial Sequence: Synthetic polypeptide
VHRIPWCTLDPGGLQCAWLRQMGGGGSGGVVCQDWEGVELCWQ

SEQ ID NO: 4022 - protein, 44 aa, Artificial Sequence
  Description of Artificial Sequence: Synthetic polypeptide
VHRIPWCTLDPGGLQCAWLRQMGGGGSGGVVCQDWEGVELCWQG

SEQ ID NO: 4023 - protein, 44 aa, Artificial Sequence
  Description of Artificial Sequence: Synthetic polypeptide
GVHRIPWCTLDPGGLQCAWLRQMGGGGSGGVVCQDWEGVELCWQ

SEQ ID NO: 4024 - protein, 45 aa, Artificial Sequence
  Description of Artificial Sequence: Synthetic polypeptide
GVHRIPWCTLDPGGLQCAWLRQMGGGGSGGVVCQDWEGVELCWQG

SEQ ID NO: 4025 - protein, 45 aa, Artificial Sequence
  Description of Artificial Sequence: Synthetic polypeptide
VHRIPWCTLDPGGLQCAWLRQMGGGGSGGVVCQDWEGVELCWQGG

SEQ ID NO: 4026 - protein, 47 aa, Artificial Sequence
  Description of Artificial Sequence: Synthetic polypeptide
GGVHRIPWCTLDPGGLQCAWLRQMGGGGSGGVVCQDWEGVELCWQGG

SEQ ID NO: 4027 - protein, 76 aa, Artificial Sequence
  Description of Artificial Sequence: Synthetic polypeptide
  MOD_RES (23)..(62): Any amino acid
  MISC_FEATURE (23)..(62): This region may encompass 1-40 residues
VHRIPWCTLDPGGLQCAWLRQMXXXXXXXXXXXXXXXXXXXXXXXXXXXXXXXXXXXXXXXXVVCQDWEGVELCWQ

SEQ ID NO: 4028 - protein, 96 aa, Artificial Sequence
  Description of Artificial Sequence: Synthetic polypeptide
  MOD_RES (1)..(10): Any amino acid
  MISC_FEATURE (1)..(10): This region may encompass 1-10 residues or be absent in its entirety
  MOD_RES (33)..(72): Any amino acid
  MISC_FEATURE (33)..(72): This region may encompass 1-40 residues
  MOD_RES (87)..(96): Any amino acid
  MISC_FEATURE (87)..(96): This region may encompass 1-10 residues or be absent in its entirety
XXXXXXXXXXVHRIPWCTLDPGGLQCAWLRQMXXXXXXXXXXXXXXXXXXXXXXXXXXXXXXXXXXXXXXXXVVCQDWEGVELCWQXXXXXXXXXX

SEQ ID NO: 4029-4040 - skipped (12 entries)

SEQ ID NO: 4041 - protein, 66 aa, Artificial Sequence
  Description of Artificial Sequence: Synthetic polypeptide
VHRIPWCTLDPGGLQCAWLRQMGGGGSGGWYPCWMAQLGELCDLDGGGGSGGVVCQDWEGVELCWQ

SEQ ID NO: 4042 - protein, 66 aa, Artificial Sequence
  Description of Artificial Sequence: Synthetic polypeptide
VHRIPWCTLDPGGLQCAWLRQMGGGGSGGVVCQDWEGVELCWQGGGGSGGWYPCWMAQLGELCDLD

SEQ ID NO: 4043 - protein, 66 aa, Artificial Sequence
  Description of Artificial Sequence: Synthetic polypeptide
WYPCWMAQLGELCDLDGGGGSGGVVCQDWEGVELCWQGGGGSGGVHRIPWCTLDPGGLQCAWLRQM

SEQ ID NO: 4044 - protein, 66 aa, Artificial Sequence
  Description of Artificial Sequence: Synthetic polypeptide
WYPCWMAQLGELCDLDGGGGSGGVHRIPWCTLDPGGLQCAWLRQMGGGGSGGVVCQDWEGVELCWQ

SEQ ID NO: 4045 - protein, 66 aa, Artificial Sequence
  Description of Artificial Sequence: Synthetic polypeptide
VVCQDWEGVELCWQGGGGSGGVHRIPWCTLDPGGLQCAWLRQMGGGGSGGWYPCWMAQLGELCDLD

SEQ ID NO: 4046 - protein, 66 aa, Artificial Sequence
  Description of Artificial Sequence: Synthetic polypeptide
VVCQDWEGVELCWQGGGGSGGWYPCWMAQLGELCDLDGGGGSGGVHRIPWCTLDPGGLQCAWLRQM

SEQ ID NO: 4047 - protein, 99 aa, Artificial Sequence
  Description of Artificial Sequence: Synthetic polypeptide
  MOD_RES (23)..(62): Any amino acid
  MISC_FEATURE (23)..(62): This region may encompass 1-40 residues
VHRIPWCTLDPGGLQCAWLRQMXXXXXXXXXXXXXXXXXXXXXXXXXXXXXXXXXXXXXXXXWYPCWMAQLGELCDLDGGGGSGGVVCQDWEGVELCWQ

SEQ ID NO: 4048 - protein, 99 aa, Artificial Sequence
  Description of Artificial Sequence: Synthetic polypeptide
  MOD_RES (23)..(62): Any amino acid
  MISC_FEATURE (23)..(62): This region may encompass 1-40 residues
VHRIPWCTLDPGGLQCAWLRQMXXXXXXXXXXXXXXXXXXXXXXXXXXXXXXXXXXXXXXXXVVCQDWEGVELCWQGGGGSGGWYPCWMAQLGELCDLD

SEQ ID NO: 4049 - protein, 99 aa, Artificial Sequence
  Description of Artificial Sequence: Synthetic polypeptide
  MOD_RES (17)..(56): Any amino acid
  MISC_FEATURE (17)..(56): This region may encompass 1-40 residues
WYPCWMAQLGELCDLDXXXXXXXXXXXXXXXXXXXXXXXXXXXXXXXXXXXXXXXXVVCQDWEGVELCWQGGGGSGGVHRIPWCTLDPGGLQCAWLRQM

SEQ ID NO: 4050 - protein, 99 aa, Artificial Sequence
  Description of Artificial Sequence: Synthetic polypeptide
  MOD_RES (17)..(56): Any amino acid
  MISC_FEATURE (17)..(56): This region may encompass 1-40 residues
WYPCWMAQLGELCDLDXXXXXXXXXXXXXXXXXXXXXXXXXXXXXXXXXXXXXXXXVHRIPWCTLDPGGLQCAWLRQMGGGGSGGVVCQDWEGVELCWQ

SEQ ID NO: 4051 - protein, 99 aa, Artificial Sequence
  Description of Artificial Sequence: Synthetic polypeptide
  MOD_RES (15)..(54): Any amino acid
  MISC_FEATURE (15)..(54): This region may encompass 1-40 residues
VVCQDWEGVELCWQXXXXXXXXXXXXXXXXXXXXXXXXXXXXXXXXXXXXXXXXVHRIPWCTLDPGGLQCAWLRQMGGGGSGGWYPCWMAQLGELCDLD

SEQ ID NO: 4052 - protein, 99 aa, Artificial Sequence
  Description of Artificial Sequence: Synthetic polypeptide
  MOD_RES (15)..(54): Any amino acid
  MISC_FEATURE (15)..(54): This region may encompass 1-40 residues
VVCQDWEGVELCWQXXXXXXXXXXXXXXXXXXXXXXXXXXXXXXXXXXXXXXXXWYPCWMAQLGELCDLDGGGGSGGVHRIPWCTLDPGGLQCAWLRQM

SEQ ID NO: 4053 - protein, 109 aa, Artificial Sequence
  Description of Artificial Sequence: Synthetic polypeptide
  MOD_RES (1)..(5): Any amino acid
  MISC_FEATURE (1)..(5): This region may encompass 1-5 residues
  MOD_RES (28)..(67): Any amino acid
  MISC_FEATURE (28)..(67): This region may encompass 1-40 residues
  MOD_RES (105)..(109): Any amino acid
  MISC_FEATURE (105)..(109): This region may encompass 1-5 residues
XXXXXVHRIPWCTLDPGGLQCAWLRQMXXXXXXXXXXXXXXXXXXXXXXXXXXXXXXXXXXXXXXXXWYPCWMAQLGELCDLDGGGGSGGVVCQDWEGVELCWQXXXXX

SEQ ID NO: 4054 - protein, 109 aa, Artificial Sequence
  Description of Artificial Sequence: Synthetic polypeptide
  MOD_RES (1)..(5): Any amino acid
  MISC_FEATURE (1)..(5): This region may encompass 1-5 residues
  MOD_RES (28)..(67): Any amino acid
  MISC_FEATURE (28)..(67): This region may encompass 1-40 residues
  MOD_RES (105)..(109): Any amino acid
  MISC_FEATURE (105)..(109): This region may encompass 1-5 residues
XXXXXVHRIPWCTLDPGGLQCAWLRQMXXXXXXXXXXXXXXXXXXXXXXXXXXXXXXXXXXXXXXXXVVCQDWEGVELCWQGGGGSGGWYPCWMAQLGELCDLDXXXXX

SEQ ID NO: 4055 - protein, 109 aa, Artificial Sequence
  Description of Artificial Sequence: Synthetic polypeptide
  MOD_RES (1)..(5): Any amino acid
  MISC_FEATURE (1)..(5): This region may encompass 1-5 residues
  MOD_RES (22)..(61): Any amino acid
  MISC_FEATURE (22)..(61): This region may encompass 1-40 residues
  MOD_RES (105)..(109): Any amino acid
  MISC_FEATURE (105)..(109): This region may encompass 1-5 residues
XXXXXWYPCWMAQLGELCDLDXXXXXXXXXXXXXXXXXXXXXXXXXXXXXXXXXXXXXXXXVVCQDWEGVELCWQGGGGSGGVHRIPWCTLDPGGLQCAWLRQMXXXXX

SEQ ID NO: 4056 - protein, 109 aa, Artificial Sequence
  Description of Artificial Sequence: Synthetic polypeptide
  MOD_RES (1)..(5): Any amino acid
  MISC_FEATURE (1)..(5): This region may encompass 1-5 residues
  MOD_RES (22)..(61): Any amino acid
  MISC_FEATURE (22)..(61): This region may encompass 1-40 residues
  MOD_RES (105)..(109): Any amino acid
  MISC_FEATURE (105)..(109): This region may encompass 1-5 residues
XXXXXWYPCWMAQLGELCDLDXXXXXXXXXXXXXXXXXXXXXXXXXXXXXXXXXXXXXXXXVHRIPWCTLDPGGLQCAWLRQMGGGGSGGVVCQDWEGVELCWQXXXXX

SEQ ID NO: 4057 - protein, 109 aa, Artificial Sequence
  Description of Artificial Sequence: Synthetic polypeptide
  MOD_RES (1)..(5): Any amino acid
  MISC_FEATURE (1)..(5): This region may encompass 1-5 residues
  MOD_RES (20)..(59): Any amino acid
  MISC_FEATURE (20)..(59): This region may encompass 1-40 residues
  MOD_RES (105)..(109): Any amino acid
  MISC_FEATURE (105)..(109): This region may encompass 1-5 residues
XXXXXVVCQDWEGVELCWQXXXXXXXXXXXXXXXXXXXXXXXXXXXXXXXXXXXXXXXXVHRIPWCTLDPGGLQCAWLRQMGGGGSGGWYPCWMAQLGELCDLDXXXXX

SEQ ID NO: 4058 - protein, 109 aa, Artificial Sequence
  Description of Artificial Sequence: Synthetic polypeptide
  MOD_RES (1)..(5): Any amino acid
  MISC_FEATURE (1)..(5): This region may encompass 1-5 residues
  MOD_RES (20)..(59): Any amino acid
  MISC_FEATURE (20)..(59): This region may encompass 1-40 residues
  MOD_RES (105)..(109): Any amino acid
  MISC_FEATURE (105)..(109): This region may encompass 1-5 residues
XXXXXVVCQDWEGVELCWQXXXXXXXXXXXXXXXXXXXXXXXXXXXXXXXXXXXXXXXXWYPCWMAQLGELCDLDGGGGSGGVHRIPWCTLDPGGLQCAWLRQMXXXXX

SEQ ID NO: 4059-4069 - skipped (11 entries)

SEQ ID NO: 4070 - protein, 47 aa, Artificial Sequence
  Description of Artificial Sequence: Synthetic polypeptide
GGWYPCWIARVGELCDLEEGPVNRGGGGSGGVVCQDWEGVELCWQGG

SEQ ID NO: 4071 - protein, 46 aa, Artificial Sequence
  Description of Artificial Sequence: Synthetic polypeptide
GGAVEFYPCWLARIGELCDLVEPGGGGSGGVVCQDWEGVELCWQGG

SEQ ID NO: 4072 - protein, 41 aa, Artificial Sequence
  Description of Artificial Sequence: Synthetic polypeptide
GGWYPCWIARVGELCDMEGGGGSGGVVCQDWEGVELCWQGG

SEQ ID NO: 4073 - protein, 45 aa, Artificial Sequence
  Description of Artificial Sequence: Synthetic polypeptide
GGEWFHDCFLAKVGDLCDLFLWGGGGSGGVVCQDWEGVELCWQGG

SEQ ID NO: 4074 - protein, 45 aa, Artificial Sequence
  Description of Artificial Sequence: Synthetic polypeptide
GGRYVHDCFIAQVGDLCDLFLHGGGGSGGVVCQDWEGVELCWQGG

SEQ ID NO: 4075 - protein, 45 aa, Artificial Sequence
  Description of Artificial Sequence: Synthetic polypeptide
GGRSLVDCFLVKVGDLCDFFNWGGGGSGGVVCQDWEGVELCWQGG

SEQ ID NO: 4076 - protein, 41 aa, Artificial Sequence
  Description of Artificial Sequence: Synthetic polypeptide
GGWYPCWIARVGELCDLEGGGGSGGVVCQDWEGVELCWQGG

SEQ ID NO: 4077 - protein, 41 aa, Artificial Sequence
  Description of Artificial Sequence: Synthetic polypeptide
GGWYPCWLAQVGELCDLDGGGGSGGVVCQDWEGVELCWQGG

SEQ ID NO: 4078 - protein, 52 aa, Artificial Sequence
  Description of Artificial Sequence: Synthetic polypeptide
GGWYPCWIARVGELCDLEEGPVNRGGGGSGGGGSGGVVCQDWEGVELCWQGG

SEQ ID NO: 4079 - protein, 57 aa, Artificial Sequence
  Description of Artificial Sequence: Synthetic polypeptide
GGWYPCWIARVGELCDLEEGPVNRGGGGSGGGGSGGGGSGGVVCQDWEGVELCWQGG

SEQ ID NO: 4080 - protein, 50 aa, Artificial Sequence
  Description of Artificial Sequence: Synthetic polypeptide
GGRYVHDCFIAQVGDLCDLFLHGGGGSGGGGSGGVVCQDWEGVELCWQGG

SEQ ID NO: 4081 - protein, 55 aa, Artificial Sequence
  Description of Artificial Sequence: Synthetic polypeptide
GGRYVHDCFIAQVGDLCDLFLHGGGGSGGGGSGGGGSGGVVCQDWEGVELCWQGG

SEQ ID NO: 4082 - protein, 60 aa, Artificial Sequence
  Description of Artificial Sequence: Synthetic polypeptide
GGRYVHDCFIAQVGDLCDLFLHGGGGSGGGGSGGGGSGGGGSGGVVCQDWEGVELCWQGG

SEQ ID NO: 4083 - protein, 41 aa, Artificial Sequence
  Description of Artificial Sequence: Synthetic polypeptide
GGLVDCFKVKVGELCDLFGGGGSGGVVCQDWEGVELCWQGG

SEQ ID NO: 4084 - protein, 45 aa, Artificial Sequence; identical to SEQ ID NO: 4074
  Description of Artificial Sequence: Synthetic polypeptide

SEQ ID NO: 4085 - protein, 41 aa, Artificial Sequence
  Description of Artificial Sequence: Synthetic polypeptide
GGWYSCWMAQLGELCDLDGGGGSGGVVCQDWEGVELCWQGG

SEQ ID NO: 4086-4089 - skipped (4 entries)

SEQ ID NO: 4090 - protein, 37 aa, Artificial Sequence; identical to SEQ ID NO: 4001
  Description of Artificial Sequence: Synthetic polypeptide

SEQ ID NO: 4091 - protein, 37 aa, Artificial Sequence
  Description of Artificial Sequence: Synthetic polypeptide
WYPCWMAQLGELCDLDGGGGSGGVVCQDWEGVALCWQ

SEQ ID NO: 4092 - protein, 37 aa, Artificial Sequence
  Description of Artificial Sequence: Synthetic polypeptide
  MOD_RES (6)..(6): Abu
WYPCWXAQLGELCDLDGGGGSGGVVCQDWEGVELCWQ

SEQ ID NO: 4093 - protein, 37 aa, Artificial Sequence
  Description of Artificial Sequence: Synthetic polypeptide
  MOD_RES (6)..(6): Abu
WYPCWXAQLGELCDLDGGGGSGGVVCQDWEGVALCWQ

SEQ ID NO: 4094 - protein, 37 aa, Artificial Sequence; identical to SEQ ID NO: 4001
  Description of Artificial Sequence: Synthetic polypeptide

SEQ ID NO: 4095 - protein, 45 aa, Artificial Sequence
  Description of Artificial Sequence: Synthetic polypeptide
GGELLVDCFKVKVGELCDLFFGGGGGSGGVVCQDWEGVELCWQGG

SEQ ID NO: 4096 - protein, 45 aa, Artificial Sequence; identical to SEQ ID NO: 4074
  Description of Artificial Sequence: Synthetic polypeptide

SEQ ID NO: 4097 - protein, 45 aa, Artificial Sequence
  Description of Artificial Sequence: Synthetic polypeptide
GGKWVHDCFLAKVGDVCDLFVVGGGGSGGVVCQDWEGVELCWQGG

SEQ ID NO: 4098 - protein, 45 aa, Artificial Sequence; identical to SEQ ID NO: 4075
  Description of Artificial Sequence: Synthetic polypeptide

SEQ ID NO: 4099 - protein, 45 aa, Artificial Sequence; identical to SEQ ID NO: 4073
  Description of Artificial Sequence: Synthetic polypeptide

SEQ ID NO: 4100-8000 - skipped (3901 entries)

SEQ ID NO: 8001 - protein, 287 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGSGSGSGSGSGSGSGSGSGSGGWYPCWMAQLGELCDLDGGGGSGGVVCQDWEGVELCWQGG

SEQ ID NO: 8002 - protein, 293 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGGSGSGSGSGSGSGSGSGSGSGGVHRIPWCTLDPGGLQCAWLRQMGGGGSGGVVCQDWEGVELCWQGG

SEQ ID NO: 8003 - protein, 295 aa, Artificial Sequence
  Description of Artificial Sequence: Synthetic polypeptide
AKTEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGSGSGSGSGSGSGSGSGSGSGGWYPCWMAQLGELCDLDGGGGSGGVVCQDWEGVELCWQGG

SEQ ID NO: 8004 - protein, 301 aa, Artificial Sequence
  Description of Artificial Sequence: Synthetic polypeptide
AKTEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGGSGSGSGSGSGSGSGSGSGSGGVHRIPWCTLDPGGLQCAWLRQMGGGGSGGVVCQDWEGVELCWQGG

SEQ ID NO: 8005 - protein, 323 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGSGSGSGSGSGSGSGSGSGSGGWYPCWMAQLGELCDLDGGGGSGGVVCQDWEGVELCWQGGGGSGGVHRIPWCTLDPGGLQCAWLRQMGG

SEQ ID NO: 8006 - protein, 323 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGSGSGSGSGSGSGSGSGSGSGGVHRIPWCTLDPGGLQCAWLRQMGGGGSGGWYPCWMAQLGELCDLDGGGGSGGVVCQDWEGVELCWQGG

SEQ ID NO: 8007 - protein, 323 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGSGSGSGSGSGSGSGSGSGSGGWYPCWMAQLGELCDLDGGGGSGGVHRIPWCTLDPGGLQCAWLRQMGGGGSGGVVCQDWEGVELCWQGG

SEQ ID NO: 8008 - protein, 289 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWMAQLGELCDLDGGGGSGGVVCQDWEGVELCWQGG

SEQ ID NO: 8009 - protein, 295 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAGSGSGSGSGSGSGSGSGSGSGGVHRIPWCTLDPGGLQCAWLRQMGGGGSGGVVCQDWEGVELCWQGG

SEQ ID NO: 8010-8011 - skipped (2 entries)

SEQ ID NO: 8012 - protein, 284 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGVVCQDWEGVELCWQGG

SEQ ID NO: 8013 - protein, 286 aa, Artificial Sequence
  Description of Artificial Sequence: Synthetic polypeptide
AEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGARTGGGGSGGGGSGGWYPCWMAQLGELCDLDGGGGSGGVVCQDWEGVELCWQGG

SEQ ID NO: 8014 - protein, 278 aa, Artificial Sequence
  Description of Artificial Sequence: Synthetic polypeptide
APPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLGSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGARTGGGGSGGGGSGGWYPCWMAQLGELCDLDGGGGSGGVVCQDWEGVELCWQGG

SEQ ID NO: 8015 - protein, 283 aa, Artificial Sequence
  Description of Artificial Sequence: Synthetic polypeptide
GGWYPCWMAQLGELCDLDGGGGSGGVVCQDWEGVELCWQGGGGSGGGGSGGGGSRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8016 - protein, 292 aa, Artificial Sequence
  Description of Artificial Sequence: Synthetic polypeptide
GITVAEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGWYPCWMAQLGELCDLDGGGGSGGVVCQDWEGVELCWQGG

SEQ ID NO: 8017 - protein, 231 aa, Artificial Sequence
  Description of Artificial Sequence: Synthetic polypeptide
EPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 8018 - protein, 218 aa, Artificial Sequence
  Description of Artificial Sequence: Synthetic polypeptide
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8019 - protein, 498 aa, Artificial Sequence
  Description of Artificial Sequence: Synthetic polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGAGGGGSGGGGSGGWYPCWMAQLGELCDLDGGGGSGGVVCQDWEGVELCWQGG

SEQ ID NO: 8020 - protein, 214 aa, Artificial Sequence
  Description of Artificial Sequence: Synthetic polypeptide
DIQMTQSPSSLSASVGDSITITCRASLSINTFLNWYQQKPGKAPNLLIYAASSLHGGVPSRFSGSGSGTDFTLTIRTLQPEDFATYYCQQSSNTPFTFGPGTVVDFRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8021 - protein, 495 aa, Artificial Sequence
  Description of Artificial Sequence: Synthetic polypeptide
EVQLLESGGVLVQPGGSLRLSCAASGFTFSNFGMTWVRQAPGKGLEWVSGISGGGRDTYFADSVKGRFTISRDNSKNTLYLQMNSLKGEDTAVYYCVKWGNIYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGAGGGGSGGGGSGGWYPCWMAQLGELCDLDGGGGSGGVVCQDWEGVELCWQGG

SEQ ID NO: 8022 - protein, 213 aa, Artificial Sequence
  Description of Artificial Sequence: Synthetic polypeptide
DIQMTQSPSTLSASVGDRVTITCSASSSISYMHWYQQKPGKAPKLLIYTTSNLASGVPARFSGSGSGTEFTLTISSLQPDDFATYYCHQRSTYPLTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8023 - protein, 497 aa, Artificial Sequence
  Description of Artificial Sequence: Synthetic polypeptide
QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAGGGGSGGGGSGGWYPCWMAQLGELCDLDGGGGSGGVVCQDWEGVELCWQGG

SEQ ID NO: 8024 - protein, 288 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAGSGSGSGSGSGSGSGSGSGSGGWYPCWMAQLGELCDLDGGGGSGGVVCQDWEGVELCWQGG

SEQ ID NO: 8025 - protein, 289 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGAGSGSGSGSGSGSGSGSGSGSGGWYPCWMAQLGELCDLDGGGGSGGVVCQDWEGVELCWQGG

SEQ ID NO: 8026 - protein, 289 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWMAQLGELCDLDGGGGSGGVVCQDWEGVELCWQGG

SEQ ID NO: 8027 - protein, 279 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGWYPCWMAQLGELCDLDGGGGSGGVVCQDWEGVELCWQGG

SEQ ID NO: 8028 - protein, 289 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGGGSGGWYPCWMAQLGELCDLDGGGGSGGVVCQDWEGVELCWQGG

SEQ ID NO: 8029 - protein, 294 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGGGSGGGGSGGWYPCWMAQLGELCDLDGGGGSGGVVCQDWEGVELCWQGG

SEQ ID NO: 8030 - protein, 276 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGWYPCWMAQLGELCDLDGGGGSGGVVCQDWEGVELCWQGG

SEQ ID NO: 8031 - protein, 279 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGGGGWYPCWMAQLGELCDLDGGGGSGGVVCQDWEGVELCWQGG

SEQ ID NO: 8032 - protein, 294 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGSGSGSGSGSGSGSGSGSGSGGWYPCWMAQLGELCDLDGGGGSGGVVCQDWEGVELCWQGG

SEQ ID NO: 8033 - protein, 284 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAGGWYPCWMAQLGELCDLDGGGGSGGVVCQDWEGVELCWQGG

SEQ ID NO: 8034 - protein, 294 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAPAPAPAPAPAGGWYPCWMAQLGELCDLDGGGGSGGVVCQDWEGVELCWQGG

SEQ ID NO: 8035 - protein, 288 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAPAPAGGWYPCWMAQLGELCDLDGGGGSGGVVCQDWEGVELCWQGG

SEQ ID NO: 8036 - protein, 288 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGVQYKKCWMAQLGDLCELDPSGGGGSGGVVCQDWEGVELCWQGG

SEQ ID NO: 8037 - protein, 288 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGYPCHMAQLGELCDLWSWGDIGGGGSGGVVCQDWEGVELCWQGG

SEQ ID NO: 8038 - protein, 282 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGYPCWMAQLGELCDLGGGGSGGVVCQDWEGVELCWQGG

SEQ ID NO: 8039 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGWSKKAEVVCEEWGGVEFCWIGG

SEQ ID NO: 8040 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGRTGVECQDWHGVELCWPVWEGG

SEQ ID NO: 8041 - protein, 286 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGVGIECEEWAGVELCWLGG

SEQ ID NO: 8042 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGTWNMSELECQDWNGVEICWHGG

SEQ ID NO: 8043 - protein, 287 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGELCDLDGGGGSGGRTEVECEDWEGVELCWLGG

SEQ ID NO: 8044 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGFYPCWTALLGELCDLEPGPPAMGGGGSGGVVCQDWEGVELCWQGG

SEQ ID NO: 8045 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWGTTWRWYPCWMAQLGELCDLEGGGGSGGVVCQDWEGVELCWQGG

SEQ ID NO: 8046 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGDVLGDRWYPCWIAKLGELCDLDGGGGSGGVVCQDWEGVELCWQGG

SEQ ID NO: 8047 - protein, 284 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWIAQLGELCDLDGGGGSGGVVCQDWEGVELCWQGG

SEQ ID NO: 8048 - protein, 284 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWLAKLGELCDLDGGGGSGGVVCQDWEGVELCWQGG

SEQ ID NO: 8049 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWYPCWMAQLGDLCDLEKPVTERGGGGSGGVVCQDWEGVELCWQGG

SEQ ID NO: 8050 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGWRRWYPCWVAQVGELCDLEIEAGGGGSGGVVCQDWEGVELCWQGG

SEQ ID NO: 8051 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGRQRWYPCWMARLGELCDLDEPTGGGGSGGVVCQDWEGVELCWQGG

SEQ ID NO: 8052 - protein, 648 aa, Artificial Sequence
  Description of Artificial Sequence: Synthetic polypeptide
GGHHHHHHGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLRTGGGGSGGGGSGGWYPCWMAQLGELCDLDGGGGSGGVVCQDWEGVELCWQGG

SEQ ID NO: 8053-8060 - skipped (8 entries)

SEQ ID NO: 8061 - protein, 295 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDLEEGPVNRGGGGSGGVVCQDWEGVELCWQGG

SEQ ID NO: 8062 - protein, 294 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGAVEFYPCWLARIGELCDLVEPGGGGSGGVVCQDWEGVELCWQGG

SEQ ID NO: 8063 - protein, 289 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDMEGGGGSGGVVCQDWEGVELCWQGG

SEQ ID NO: 8064 - protein, 293 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGEWFHDCFLAKVGDLCDLFLWGGGGSGGVVCQDWEGVELCWQGG

SEQ ID NO: 8065 - protein, 293 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGRYVHDCFIAQVGDLCDLFLHGGGGSGGVVCQDWEGVELCWQGG

SEQ ID NO: 8066 - protein, 293 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGRSLVDCFLVKVGDLCDFFNWGGGGSGGVVCQDWEGVELCWQGG

SEQ ID NO: 8067 - protein, 289 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDLEGGGGSGGVVCQDWEGVELCWQGG

SEQ ID NO: 8068 - protein, 289 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWLAQVGELCDLDGGGGSGGVVCQDWEGVELCWQGG

SEQ ID NO: 8069 - protein, 300 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDLEEGPVNRGGGGSGGGGSGGVVCQDWEGVELCWQGG

SEQ ID NO: 8070 - protein, 305 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDLEEGPVNRGGGGSGGGGSGGGGSGGVVCQDWEGVELCWQGG

SEQ ID NO: 8071 - protein, 310 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGWYPCWIARVGELCDLEEGPVNRGGGGSGGGGSGGGGSGGGGSGGVVCQDWEGVELCWQGG

SEQ ID NO: 8072 - protein, 298 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGRYVHDCFIAQVGDLCDLFLHGGGGSGGGGSGGVVCQDWEGVELCWQGG

SEQ ID NO: 8073 - protein, 303 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGRYVHDCFIAQVGDLCDLFLHGGGGSGGGGSGGGGSGGVVCQDWEGVELCWQGG

SEQ ID NO: 8074 - protein, 308 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGAPAPAPAPAPAPAPAPAPAPAGGRYVHDCFIAQVGDLCDLFLHGGGGSGGGGSGGGGSGGGGSGGVVCQDWEGVELCWQGG

SEQ ID NO: 8075 - protein, 288 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGAPAPAPAPAPAPAPAPAPAPAGGLVDCFKVKVGELCDLFGGGGSGGVVCQDWEGVELCWQGG

SEQ ID NO: 8076 - protein, 226 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYVLPPSRDELTKNQVSLLCLVKGFYPSDIAVEWESNGQPENNYLTWPPVLDSDGSFFLYSKLTVDKSRWQQGNVFSCSVMHEALHNHYTQKSLSLSPG

SEQ ID NO: 8077 - protein, 288 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGAPAPAPAPAPAPAPAPAPAPAGGLVDCFKVKVGELCDLFGGGGSGGVVCQDWEGVELCWQGG

SEQ ID NO: 8078 - protein, 226 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 8079 - protein, 292 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGAPAPAPAPAPAPAPAPAPAPAGGRYVHDCFIAQVGDLCDLFLHGGGGSGGVVCQDWEGVELCWQGG

SEQ ID NO: 8080 - protein, 292 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGAPAPAPAPAPAPAPAPAPAPAGGRYVHDCFIAQVGDLCDLFLHGGGGSGGVVCQDWEGVELCWQGG

SEQ ID NO: 8081 - protein, 287 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYVYPPSRDELTKNQVSLTCLVKGFYPSDIAVEWESNGQPENNYKTTPPVLDSDGSFALVSKLTVDKSRWQQGNVFSCSVMHEALHNHYTQKSLSLSPGGSGSGSGSGSGSGSGSGSGSGGWYSCWMAQLGELCDLDGGGGSGGVVCQDWEGVELCWQGG

SEQ ID NO: 8082 - protein, 287 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGSGSGSGSGSGSGSGSGSGSGGWYSCWMAQLGELCDLDGGGGSGGVVCQDWEGVELCWQGG

SEQ ID NO: 8083-8100 - skipped (18 entries)

SEQ ID NO: 8101 - protein, 287 aa, Artificial Sequence; identical to SEQ ID NO: 8001
  Description of Artificial Sequence: Synthetic polypeptide

SEQ ID NO: 8102 - protein, 293 aa, Artificial Sequence; identical to SEQ ID NO: 8002
  Description of Artificial Sequence: Synthetic polypeptide

SEQ ID NO: 8103-8110 - skipped (8 entries)

SEQ ID NO: 8111 - protein, 233 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGART

SEQ ID NO: 8112 - protein, 300 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGSGSGSGSGSGSGSGSGSGSGGVHRIPWCTLDPGGLQCAWLRQMGGGGSGGVVCQDWEGVELCWQGG

SEQ ID NO: 8113 - protein, 292 aa, Artificial Sequence
  Description of Artificial Sequence: Synthetic polypeptide
AEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGARTGGGGSGGGGSGGVHRIPWCTLDPGGLQCAWLRQMGGGGSGGVVCQDWEGVELCWQGG

SEQ ID NO: 8114 - protein, 284 aa, Artificial Sequence
  Description of Artificial Sequence: Synthetic polypeptide
APPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLGSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGARTGGGGSGGGGSGGVHRIPWCTLDPGGLQCAWLRQMGGGGSGGVVCQDWEGVELCWQGG

SEQ ID NO: 8115 - protein, 289 aa, Artificial Sequence
  Description of Artificial Sequence: Synthetic polypeptide
GGVHRIPWCTLDPGGLQCAWLRQMGGGGSGGVVCQDWEGVELCWQGGGGSGGGGSGGGGSRSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8116 - protein, 298 aa, Artificial Sequence
  Description of Artificial Sequence: Synthetic polypeptide
GITVAEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSGGVHRIPWCTLDPGGLQCAWLRQMGGGGSGGVVCQDWEGVELCWQGG

SEQ ID NO: 8117 - protein, 231 aa, Artificial Sequence; identical to SEQ ID NO: 8017
  Description of Artificial Sequence: Synthetic polypeptide

SEQ ID NO: 8118 - protein, 218 aa, Artificial Sequence; identical to SEQ ID NO: 8018
  Description of Artificial Sequence: Synthetic polypeptide

SEQ ID NO: 8119 - protein, 514 aa, Artificial Sequence
  Description of Artificial Sequence: Synthetic polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGAGSGSGSGSGSGSGSGSGSGSGGVHRIPWCTLDPGGLQCAWLRQMGGGGSGGVVCQDWEGVELCWQGG

SEQ ID NO: 8120-8123 - skipped (4 entries)

SEQ ID NO: 8124 - protein, 294 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGAGSGSGSGSGSGSGSGSGSGSGGVHRIPWCTLDPGGLQCAWLRQMGGGGSGGVVCQDWEGVELCWQGG

SEQ ID NO: 8125 - protein, 295 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGAGSGSGSGSGSGSGSGSGSGSGGVHRIPWCTLDPGGLQCAWLRQMGGGGSGGVVCQDWEGVELCWQGG

SEQ ID NO: 8126 - protein, 295 aa, Artificial Sequence
  Description of Artificial Sequence: Synthetic polypeptide
ERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGAPAPAPAPAPAPAPAPAPAPAGGVHRIPWCTLDPGGLQCAWLRQMGGGGSGGVVCQDWEGVELCWQGG

SEQ ID NO: 8127 - protein, 285 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGVHRIPWCTLDPGGLQCAWLRQMGGGGSGGVVCQDWEGVELCWQGG

SEQ ID NO: 8128 - protein, 295 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGGGSGGVHRIPWCTLDPGGLQCAWLRQMGGGGSGGVVCQDWEGVELCWQGG

SEQ ID NO: 8129 - protein, 300 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGSGGGGSGGGGSGGGGSGGVHRIPWCTLDPGGLQCAWLRQMGGGGSGGVVCQDWEGVELCWQGG

SEQ ID NO: 8130 - protein, 282 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGVHRIPWCTLDPGGLQCAWLRQMGGGGSGGVVCQDWEGVELCWQGG

SEQ ID NO: 8131 - protein, 285 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTGGGGGGGVHRIPWCTLDPGGLQCAWLRQMGGGGSGGVVCQDWEGVELCWQGG

SEQ ID NO: 8132 - protein, 300 aa, Artificial Sequence; identical to SEQ ID NO: 8112
  Description of Artificial Sequence: Synthetic polypeptide

SEQ ID NO: 8133 - protein, 290 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAGGVHRIPWCTLDPGGLQCAWLRQMGGGGSGGVVCQDWEGVELCWQGG

SEQ ID NO: 8134 - protein, 300 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAPAPAPAPAPAGGVHRIPWCTLDPGGLQCAWLRQMGGGGSGGVVCQDWEGVELCWQGG

SEQ ID NO: 8135 - protein, 294 aa, Artificial Sequence
  Description of Artificial Sequence: Synthetic polypeptide
APLERKSSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGARTPAPAPAPAPAPAPAGGVHRIPWCTLDPGGLQCAWLRQMGGGGSGGVVCQDWEGVELCWQGG

SEQ ID NO: 8136-8151 - skipped (16 entries)

SEQ ID NO: 8152 - protein, 654 aa, Artificial Sequence
  Description of Artificial Sequence: Synthetic polypeptide
GGHHHHHHGGDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLRTGGGGSGGGGSGGVHRIPWCTLDPGGLQCAWLRQMGGGGSGGVVCQDWEGVELCWQGG

SEQ ID NO: 8153-9000 - skipped (848 entries)

SEQ ID NO: 9001 - protein, 20 aa, Artificial Sequence
  Description of Artificial Sequence: Synthetic peptide
YPCWLARVGELCDLDSGDVH

SEQ ID NO: 9002 - protein, 20 aa, Artificial Sequence
  Description of Artificial Sequence: Synthetic peptide
APCWLARVGELCDLDSGDVH

SEQ ID NO: 9003 - protein, 20 aa, Artificial Sequence
  Description of Artificial Sequence: Synthetic peptide
APCALARVGELCDLDSGDVH

SEQ ID NO: 9004 - protein, 20 aa, Artificial Sequence
  Description of Artificial Sequence: Synthetic peptide
APCALAAVGELCDLDSGDVH

SEQ ID NO: 9005 - protein, 20 aa, Artificial Sequence
  Description of Artificial Sequence: Synthetic peptide
APCALAAVGALCDLDSGDVH

SEQ ID NO: 9006 - protein, 20 aa, Artificial Sequence
  Description of Artificial Sequence: Synthetic peptide
APCALAAVGALCDLASGDVH

SEQ ID NO: 9007 - protein, 20 aa, Artificial Sequence
  Description of Artificial Sequence: Synthetic peptide
APCALAAVGALCDLAAGDVH

SEQ ID NO: 9008-9010 - skipped (3 entries)

SEQ ID NO: 9011 - protein, 14 aa, Artificial Sequence
  Description of Artificial Sequence: Synthetic peptide
YWCWMAQVGELCDL

SEQ ID NO: 9012 - protein, 14 aa, Artificial Sequence
  Description of Artificial Sequence: Synthetic peptide
YHCWMAQVGELCDL

SEQ ID NO: 9013 - protein, 14 aa, Artificial Sequence
  Description of Artificial Sequence: Synthetic peptide
YHCWMGQVGELCDL

SEQ ID NO: 9014 - protein, 14 aa, Artificial Sequence
  Description of Artificial Sequence: Synthetic peptide
YHCWMGQMGELCDL

SEQ ID NO: 9015 - protein, 14 aa, Artificial Sequence
  Description of Artificial Sequence: Synthetic peptide
YHCWMGQMGELCEL

SEQ ID NO: 9016 - protein, 14 aa, Artificial Sequence
  Description of Artificial Sequence: Synthetic peptide
YHCWMGQMGELCEM

SEQ ID NO: 9017-9020 - skipped (4 entries)

SEQ ID NO: 9021 - protein, 20 aa, Artificial Sequence
  Description of Artificial Sequence: Synthetic peptide
MGFYPCWTAQLGELCDLSVD

SEQ ID NO: 9022 - protein, 19 aa, Artificial Sequence
  Description of Artificial Sequence: Synthetic peptide
GFYPCWTAQLGELCDLSVD

SEQ ID NO: 9023 - protein, 18 aa, Artificial Sequence
  Description of Artificial Sequence: Synthetic peptide
FYPCWTAQLGELCDLSVD

SEQ ID NO: 9024 - protein, 17 aa, Artificial Sequence
  Description of Artificial Sequence: Synthetic peptide
YPCWTAQLGELCDLSVD

SEQ ID NO: 9025 - protein, 19 aa, Artificial Sequence
  Description of Artificial Sequence: Synthetic peptide
MGFYPCWTAQLGELCDLSV

SEQ ID NO: 9026 - protein, 18 aa, Artificial Sequence
  Description of Artificial Sequence: Synthetic peptide
MGFYPCWTAQLGELCDLS

SEQ ID NO: 9027 - protein, 17 aa, Artificial Sequence
  Description of Artificial Sequence: Synthetic peptide
MGFYPCWTAQLGELCDL

SEQ ID NO: 9028 - protein, 18 aa, Artificial Sequence
  Description of Artificial Sequence: Synthetic peptide
GFYPCWTAQLGELCDLSV

SEQ ID NO: 9029 - protein, 15 aa, Artificial Sequence
  Description of Artificial Sequence: Synthetic peptide
FYPCWTAQLGELCDL

SEQ ID NO: 9030 - skipped

SEQ ID NO: 9031 - protein, 14 aa, Artificial Sequence
  Description of Artificial Sequence: Synthetic peptide
KYCGFAQLGELCVL

SEQ ID NO: 9032 - protein, 15 aa, Artificial Sequence
  Description of Artificial Sequence: Synthetic peptide
GKYCGFAQLGELCVL

SEQ ID NO: 9033 - protein, 16 aa, Artificial Sequence
  Description of Artificial Sequence: Synthetic peptide
GGKYCGFAQLGELCVL

SEQ ID NO: 9034 - protein, 17 aa, Artificial Sequence
  Description of Artificial Sequence: Synthetic peptide
GGGKYCGFAQLGELCVL

SEQ ID NO: 9035 - protein, 15 aa, Artificial Sequence
  Description of Artificial Sequence: Synthetic peptide
KYCGFAQLGELCVLG

SEQ ID NO: 9036 - protein, 16 aa, Artificial Sequence
  Description of Artificial Sequence: Synthetic peptide
KYCGFAQLGELCVLGG

SEQ ID NO: 9037 - protein, 17 aa, Artificial Sequence
  Description of Artificial Sequence: Synthetic peptide
KYCGFAQLGELCVLGGG

SEQ ID NO: 9038 - protein, 16 aa, Artificial Sequence
  Description of Artificial Sequence: Synthetic peptide
GKYCGFAQLGELCVLG

SEQ ID NO: 9039 - protein, 17 aa, Artificial Sequence
  Description of Artificial Sequence: Synthetic peptide
GGKYCGFAQLGELCVLG

SEQ ID NO: 9040-9300 - skipped (261 entries)

SEQ ID NO: 9301 - protein, 20 aa, Artificial Sequence
  Description of Artificial Sequence: Synthetic peptide
GGWYPCWMAQLGELCDLDGG

SEQ ID NO: 9302 - protein, 19 aa, Artificial Sequence
  Description of Artificial Sequence: Synthetic peptide
GWYPCWMAQLGELCDLDGG

SEQ ID NO: 9303 - protein, 18 aa, Artificial Sequence
  Description of Artificial Sequence: Synthetic peptide
WYPCWMAQLGELCDLDGG

SEQ ID NO: 9304 - protein, 17 aa, Artificial Sequence
  Description of Artificial Sequence: Synthetic peptide
YPCWMAQLGELCDLDGG

SEQ ID NO: 9305 - protein, 16 aa, Artificial Sequence
  Description of Artificial Sequence: Synthetic peptide
PCWMAQLGELCDLDGG

SEQ ID NO: 9306 - protein, 15 aa, Artificial Sequence
  Description of Artificial Sequence: Synthetic peptide
CWMAQLGELCDLDGG

SEQ ID NO: 9307 - protein, 19 aa, Artificial Sequence
  Description of Artificial Sequence: Synthetic peptide
GGWYPCWMAQLGELCDLDG

SEQ ID NO: 9308 - protein, 18 aa, Artificial Sequence
  Description of Artificial Sequence: Synthetic peptide
GGWYPCWMAQLGELCDLD

SEQ ID NO: 9309 - protein, 17 aa, Artificial Sequence
  Description of Artificial Sequence: Synthetic peptide
GGWYPCWMAQLGELCDL

SEQ ID NO: 9310 - protein, 16 aa, Artificial Sequence
  Description of Artificial Sequence: Synthetic peptide
GGWYPCWMAQLGELCD

SEQ ID NO: 9311 - protein, 15 aa, Artificial Sequence
  Description of Artificial Sequence: Synthetic peptide
GGWYPCWMAQLGELC

SEQ ID NO: 9312 - protein, 18 aa, Artificial Sequence
  Description of Artificial Sequence: Synthetic peptide
GWYPCWMAQLGELCDLDG

SEQ ID NO: 9313 - protein, 17 aa, Artificial Sequence
  Description of Artificial Sequence: Synthetic peptide
WYPCWMAQLGELCDLDG

SEQ ID NO: 9314 - protein, 14 aa, Artificial Sequence
  Description of Artificial Sequence: Synthetic peptide
YPCWMAQLGELCDL

SEQ ID NO: 9315 - protein, 13 aa, Artificial Sequence
  Description of Artificial Sequence: Synthetic peptide
PCWMAQLGELCDL

SEQ ID NO: 9316-9319 - skipped (4 entries)

SEQ ID NO: 9320 - protein, 24 aa, Artificial Sequence
  Description of Artificial Sequence: Synthetic peptide
VHRIPWCTLDPGGLQCAWLRQMGG

SEQ ID NO: 9321 - protein, 21 aa, Artificial Sequence
  Description of Artificial Sequence: Synthetic peptide
VHRIPWCTLDPGGLQCAWLRQ

SEQ ID NO: 9322 - protein, 20 aa, Artificial Sequence
  Description of Artificial Sequence: Synthetic peptide
VHRIPWCTLDPGGLQCAWLR

SEQ ID NO: 9323 - protein, 19 aa, Artificial Sequence
  Description of Artificial Sequence: Synthetic peptide
VHRIPWCTLDPGGLQCAWL

SEQ ID NO: 9324 - protein, 18 aa, Artificial Sequence
  Description of Artificial Sequence: Synthetic peptide
VHRIPWCTLDPGGLQCAW

SEQ ID NO: 9325 - protein, 17 aa, Artificial Sequence
  Description of Artificial Sequence: Synthetic peptide
VHRIPWCTLDPGGLQCA

SEQ ID NO: 9326 - protein, 16 aa, Artificial Sequence
  Description of Artificial Sequence: Synthetic peptide
VHRIPWCTLDPGGLQC

SEQ ID NO: 9327 - protein, 23 aa, Artificial Sequence
  Description of Artificial Sequence: Synthetic peptide
HRIPWCTLDPGGLQCAWLRQMGG

SEQ ID NO: 9328 - protein, 22 aa, Artificial Sequence
  Description of Artificial Sequence: Synthetic peptide
RIPWCTLDPGGLQCAWLRQMGG

SEQ ID NO: 9329 - protein, 21 aa, Artificial Sequence
  Description of Artificial Sequence: Synthetic peptide
IPWCTLDPGGLQCAWLRQMGG

SEQ ID NO: 9330 - protein, 20 aa, Artificial Sequence
  Description of Artificial Sequence: Synthetic peptide
PWCTLDPGGLQCAWLRQMGG

SEQ ID NO: 9331 - protein, 19 aa, Artificial Sequence
  Description of Artificial Sequence: Synthetic peptide
WCTLDPGGLQCAWLRQMGG

SEQ ID NO: 9332 - protein, 18 aa, Artificial Sequence
  Description of Artificial Sequence: Synthetic peptide
CTLDPGGLQCAWLRQMGG

SEQ ID NO: 9333-9339 - skipped (7 entries)

SEQ ID NO: 9340 - protein, 18 aa, Artificial Sequence
  Description of Artificial Sequence: Synthetic peptide
GGVVCQDWEGVELCWQGG

SEQ ID NO: 9341 - protein, 17 aa, Artificial Sequence
  Description of Artificial Sequence: Synthetic peptide
GVVCQDWEGVELCWQGG

SEQ ID NO: 9342 - protein, 16 aa, Artificial Sequence
  Description of Artificial Sequence: Synthetic peptide
VVCQDWEGVELCWQGG

SEQ ID NO: 9343 - protein, 15 aa, Artificial Sequence
  Description of Artificial Sequence: Synthetic peptide
VCQDWEGVELCWQGG

SEQ ID NO: 9344 - protein, 14 aa, Artificial Sequence
  Description of Artificial Sequence: Synthetic peptide
CQDWEGVELCWQGG

SEQ ID NO: 9345 - protein, 17 aa, Artificial Sequence
  Description of Artificial Sequence: Synthetic peptide
GGVVCQDWEGVELCWQG

SEQ ID NO: 9346 - protein, 16 aa, Artificial Sequence
  Description of Artificial Sequence: Synthetic peptide
GGVVCQDWEGVELCWQ

SEQ ID NO: 9347 - protein, 15 aa, Artificial Sequence
  Description of Artificial Sequence: Synthetic peptide
GGVVCQDWEGVELCW

SEQ ID NO: 9348 - protein, 14 aa, Artificial Sequence
  Description of Artificial Sequence: Synthetic peptide
GGVVCQDWEGVELC

SEQ ID NO: 9349 - protein, 16 aa, Artificial Sequence
  Description of Artificial Sequence: Synthetic peptide
GVVCQDWEGVELCWQG

SEQ ID NO: 9350 - protein, 13 aa, Artificial Sequence
  Description of Artificial Sequence: Synthetic peptide
VCQDWEGVELCWQ

SEQ ID NO: 9351 - protein, 12 aa, Artificial Sequence
  Description of Artificial Sequence: Synthetic peptide
VCQDWEGVELCW

SEQ ID NO: 9352 - protein, 11 aa, Artificial Sequence
  Description of Artificial Sequence: Synthetic peptide
CQDWEGVELCW

SEQ ID NO: 9353 - protein, 10 aa, Artificial Sequence
  Description of Artificial Sequence: Synthetic peptide
CQDWEGVELC

SEQ ID NO: 9354-9369 - skipped (16 entries)

SEQ ID NO: 9370 - protein, 18 aa, Artificial Sequence
  Description of Artificial Sequence: Synthetic peptide
GGVVCQDWEGVELCWQGG

SEQ ID NO: 9371 - protein, 18 aa, Artificial Sequence
  Description of Artificial Sequence: Synthetic peptide
GGVVCADWEGVELCWQGG

SEQ ID NO: 9372 - protein, 18 aa, Artificial Sequence
  Description of Artificial Sequence: Synthetic peptide
GGVVCQAWEGVELCWQGG

SEQ ID NO: 9373 - protein, 18 aa, Artificial Sequence
  Description of Artificial Sequence: Synthetic peptide
GGVVCQDAEGVELCWQGG

SEQ ID NO: 9374 - protein, 18 aa, Artificial Sequence
  Description of Artificial Sequence: Synthetic peptide
GGVVCQDWAGVELCWQGG

SEQ ID NO: 9375 - protein, 18 aa, Artificial Sequence
  Description of Artificial Sequence: Synthetic peptide
GGVVCQDWEAVELCWQGG

SEQ ID NO: 9376 - protein, 18 aa, Artificial Sequence
  Description of Artificial Sequence: Synthetic peptide
GGVVCQDWEGAELCWQGG

SEQ ID NO: 9377 - protein, 18 aa, Artificial Sequence
  Description of Artificial Sequence: Synthetic peptide
GGVVCQDWEGVALCWQGG

SEQ ID NO: 9378 - protein, 18 aa, Artificial Sequence
  Description of Artificial Sequence: Synthetic peptide
GGVVCQDWEGVEACWQGG

SEQ ID NO: 9379 - skipped

SEQ ID NO: 9380 - protein, 20 aa, Artificial Sequence
  Description of Artificial Sequence: Synthetic peptide
  MISC_FEATURE (1)..(20): This sequence may encompass 1-20 residues
GGGGGGGGGGGGGGGGGGGG

SEQ ID NO: 9381 - protein, 40 aa, Artificial Sequence
  Description of Artificial Sequence: Synthetic polypeptide
  MISC_FEATURE (1)..(40): This sequence may encompass 1-20 "Gly Ser" repeating units
GSGSGSGSGSGSGSGSGSGSGSGSGSGSGSGSGSGSGSGS

SEQ ID NO: 9382 - protein, 60 aa, Artificial Sequence
  Description of Artificial Sequence: Synthetic polypeptide
  MISC_FEATURE (1)..(60): This sequence may encompass 1-20 "Gly Gly Ser" repeating units
GGSGGSGGSGGSGGSGGSGGSGGSGGSGGSGGSGGSGGSGGSGGSGGSGGSGGSGGSGGS

SEQ ID NO: 9383 - protein, 80 aa, Artificial Sequence
  Description of Artificial Sequence: Synthetic polypeptide
  MISC_FEATURE (1)..(80): This sequence may encompass 1-20 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 9384 - protein, 100 aa, Artificial Sequence
  Description of Artificial Sequence: Synthetic polypeptide
  MISC_FEATURE (1)..(100): This sequence may encompass 1-20 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 9385 - protein, 10 aa, Artificial Sequence
  Description of Artificial Sequence: Synthetic peptide
  MISC_FEATURE (1)..(10): This sequence may encompass 1-10 residues
GGGGGGGGGG

SEQ ID NO: 9386 - protein, 20 aa, Artificial Sequence
  Description of Artificial Sequence: Synthetic peptide
  MISC_FEATURE (1)..(20): This sequence may encompass 1-10 "Gly Ser" repeating units
GSGSGSGSGSGSGSGSGSGS

SEQ ID NO: 9387 - protein, 30 aa, Artificial Sequence
  Description of Artificial Sequence: Synthetic polypeptide
  MISC_FEATURE (1)..(30): This sequence may encompass 1-10 "Gly Gly Ser" repeating units
GGSGGSGGSGGSGGSGGSGGSGGSGGSGGS

SEQ ID NO: 9388 - protein, 40 aa, Artificial Sequence
  Description of Artificial Sequence: Synthetic polypeptide
  MISC_FEATURE (1)..(40): This sequence may encompass 1-10 "Gly Gly Gly Ser" repeating units
GGGSGGGSGGGSGGGSGGGSGGGSGGGSGGGSGGGSGGGS

SEQ ID NO: 9389 - protein, 50 aa, Artificial Sequence
  Description of Artificial Sequence: Synthetic polypeptide
  MISC_FEATURE (1)..(50): This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 9390 - protein, 5 aa, Artificial Sequence
  Description of Artificial Sequence: Synthetic peptide
  MISC_FEATURE (1)..(5): This sequence may encompass 1-5 residues
GGGGG

SEQ ID NO: 9391 - protein, 10 aa, Artificial Sequence
  Description of Artificial Sequence: Synthetic peptide
  MISC_FEATURE (1)..(10): This sequence may encompass 1-5 "Gly Ser" repeating units
GSGSGSGSGS

SEQ ID NO: 9392 - protein, 15 aa, Artificial Sequence
  Description of Artificial Sequence: Synthetic peptide
  MISC_FEATURE (1)..(15): This sequence may encompass 1-5 "Gly Gly Ser" repeating units
GGSGGSGGSGGSGGS

SEQ ID NO: 9393 - protein, 20 aa, Artificial Sequence
  Description of Artificial Sequence: Synthetic peptide
  MISC_FEATURE (1)..(20): This sequence may encompass 1-5 "Gly Gly Gly Ser" repeating units
GGGSGGGSGGGSGGGSGGGS

SEQ ID NO: 9394 - protein, 25 aa, Artificial Sequence
  Description of Artificial Sequence: Synthetic peptide
  MISC_FEATURE (1)..(25): This sequence may encompass 1-5 "Gly Gly Gly Gly Ser" repeating units
GGGGSGGGGSGGGGSGGGGSGGGGS

SEQ ID NO: 9395 - protein, 5 aa, Artificial Sequence
  Description of Artificial Sequence: Synthetic peptide
GGGGS

SEQ ID NO: 9396 - protein, 10 aa, Artificial Sequence
  Description of Artificial Sequence: Synthetic peptide
GGGGSGGGGS

SEQ ID NO: 9397 - protein, 15 aa, Artificial Sequence
  Description of Artificial Sequence: Synthetic peptide
GGGGSGGGGSGGGGS

SEQ ID NO: 9398 - protein, 20 aa, Artificial Sequence
  Description of Artificial Sequence: Synthetic peptide
GGGGSGGGGSGGGGSGGGGS

SEQ ID NO: 9399 - protein, 2 aa, Artificial Sequence
  Description of Artificial Sequence: Synthetic peptide
GG

SEQ ID NO: 9400 - protein, 3 aa, Artificial Sequence
  Description of Artificial Sequence: Synthetic peptide
GGG

SEQ ID NO: 9401 - protein, 5 aa, Artificial Sequence
  Description of Artificial Sequence: Synthetic peptide
GGGGG

SEQ ID NO: 9402 - protein, 3 aa, Artificial Sequence
  Description of Artificial Sequence: Synthetic peptide
GGS

SEQ ID NO: 9403 - protein, 4 aa, Artificial Sequence
  Description of Artificial Sequence: Synthetic peptide
GGGS

SEQ ID NO: 9404 - protein, 7 aa, Artificial Sequence
  Description of Artificial Sequence: Synthetic peptide
GGGGSGG

SEQ ID NO: 9405 - protein, 6 aa, Artificial Sequence
  Description of Artificial Sequence: Synthetic peptide
GGSGGS

SEQ ID NO: 9406 - protein, 5 aa, Artificial Sequence
  Description of Artificial Sequence: Synthetic peptide
GGGGG

SEQ ID NO: 9407 - protein, 20 aa, Artificial Sequence
  Description of Artificial Sequence: Synthetic peptide
GSGSGSGSGSGSGSGSGSGS

SEQ ID NO: 9408-9419 - skipped (12 entries)

SEQ ID NO: 9420 - protein, 20 aa, Artificial Sequence
  Description of Artificial Sequence: Synthetic peptide
  MISC_FEATURE (1)..(20): This sequence may encompass 1-20 residues
PPPPPPPPPPPPPPPPPPPP

SEQ ID NO: 9421 - protein, 40 aa, Artificial Sequence
  Description of Artificial Sequence: Synthetic polypeptide
  MISC_FEATURE (1)..(40): This sequence may encompass 1-20 "Pro Ala" repeating units
PAPAPAPAPAPAPAPAPAPAPAPAPAPAPAPAPAPAPAPA

SEQ ID NO: 9422 - protein, 10 aa, Artificial Sequence
  Description of Artificial Sequence: Synthetic peptide
  MISC_FEATURE (1)..(10): This sequence may encompass 1-10 residues
PPPPPPPPPP

SEQ ID NO: 9423 - protein, 20 aa, Artificial Sequence
  Description of Artificial Sequence: Synthetic peptide
  MISC_FEATURE (1)..(20): This sequence may encompass 1-10 "Pro Ala" repeating units
PAPAPAPAPAPAPAPAPAPA

SEQ ID NO: 9424 - protein, 5 aa, Artificial Sequence
  Description of Artificial Sequence: Synthetic peptide
  MISC_FEATURE (1)..(5): This sequence may encompass 1-5 residues
PPPPP

SEQ ID NO: 9425 - protein, 10 aa, Artificial Sequence
  Description of Artificial Sequence: Synthetic peptide
  MISC_FEATURE (1)..(10): This sequence may encompass 1-5 "Pro Ala" repeating units
PAPAPAPAPA

SEQ ID NO: 9426 - protein, 10 aa, Artificial Sequence
  Description of Artificial Sequence: Synthetic peptide
PAPAPAPAPA

SEQ ID NO: 9427 - protein, 14 aa, Artificial Sequence
  Description of Artificial Sequence: Synthetic peptide
PAPAPAPAPAPAPA

SEQ ID NO: 9428 - protein, 20 aa, Artificial Sequence
  Description of Artificial Sequence: Synthetic peptide
PAPAPAPAPAPAPAPAPAPA

SEQ ID NO: 9429-9500 - skipped (72 entries)

SEQ ID NO: 9501 - protein, 12 aa, Artificial Sequence
  Description of Artificial Sequence: Synthetic peptide
ARSDYGLGAIWP

SEQ ID NO: 9502 - protein, 15 aa, Artificial Sequence
  Description of Artificial Sequence: Synthetic peptide
FPVPRWGDWGDLIEL

SEQ ID NO: 9503 - protein, 15 aa, Artificial Sequence
  Description of Artificial Sequence: Synthetic peptide
GVQSRWGDVGDLIPW

SEQ ID NO: 9504 - protein, 10 aa, Artificial Sequence
  Description of Artificial Sequence: Synthetic peptide
GTQEACFGLL

SEQ ID NO: 9505 - protein, 12 aa, Artificial Sequence
  Description of Artificial Sequence: Synthetic peptide
HCLDMGCTFPVW

SEQ ID NO: 9506 - protein, 14 aa, Artificial Sequence
  Description of Artificial Sequence: Synthetic peptide
ISAGRWGDVGDLIP

SEQ ID NO: 9507 - protein, 12 aa, Artificial Sequence
  Description of Artificial Sequence: Synthetic peptide
IDCGVATVGELC

SEQ ID NO: 9508 - protein, 12 aa, Artificial Sequence
  Description of Artificial Sequence: Synthetic peptide
ISCSEAGLGELC

SEQ ID NO: 9509 - protein, 12 aa, Artificial Sequence
  Description of Artificial Sequence: Synthetic peptide
IDCSQAMLGELC

SEQ ID NO: 9510 - protein, 12 aa, Artificial Sequence
  Description of Artificial Sequence: Synthetic peptide
IDCSEAWLGELC

SEQ ID NO: 9511 - protein, 12 aa, Artificial Sequence
  Description of Artificial Sequence: Synthetic peptide
IDCSEAALGTLC

SEQ ID NO: 9512 - protein, 12 aa, Artificial Sequence
  Description of Artificial Sequence: Synthetic peptide
IDCSEAGLGELC

SEQ ID NO: 9513 - protein, 12 aa, Artificial Sequence
  Description of Artificial Sequence: Synthetic peptide
IDCSEAALGELC

SEQ ID NO: 9514 - protein, 12 aa, Artificial Sequence
  Description of Artificial Sequence: Synthetic peptide
INCSEAVIGQLC

SEQ ID NO: 9515 - protein, 12 aa, Artificial Sequence
  Description of Artificial Sequence: Synthetic peptide
IDCSNAVVGQLC

SEQ ID NO: 9516 - protein, 12 aa, Artificial Sequence
  Description of Artificial Sequence: Synthetic peptide
IDCSAAGLGELC

SEQ ID NO: 9517 - protein, 12 aa, Artificial Sequence
  Description of Artificial Sequence: Synthetic peptide
IDCGVATVGELC

SEQ ID NO: 9518 - protein, 12 aa, Artificial Sequence
  Description of Artificial Sequence: Synthetic peptide
IDCSEAALGELC

SEQ ID NO: 9519 - protein, 12 aa, Artificial Sequence
  Description of Artificial Sequence: Synthetic peptide
INCSEAVIGDLC

SEQ ID NO: 9520 - protein, 12 aa, Artificial Sequence
  Description of Artificial Sequence: Synthetic peptide
IDCSQAMLGELC

SEQ ID NO: 9521 - protein, 12 aa, Artificial Sequence
  Description of Artificial Sequence: Synthetic peptide
IDCSEAVLGELC

SEQ ID NO: 9522 - protein, 12 aa, Artificial Sequence
  Description of Artificial Sequence: Synthetic peptide
IDCSAAGLGELC

SEQ ID NO: 9523 - protein, 12 aa, Artificial Sequence
  Description of Artificial Sequence: Synthetic peptide
IDCSEAALGTLC

SEQ ID NO: 9524 - protein, 12 aa, Artificial Sequence
  Description of Artificial Sequence: Synthetic peptide
ISCSEAGLGELC

SEQ ID NO: 9525 - protein, 12 aa, Artificial Sequence
  Description of Artificial Sequence: Synthetic peptide
ISCSEAGLGELC

SEQ ID NO: 9526 - protein, 12 aa, Artificial Sequence
  Description of Artificial Sequence: Synthetic peptide
IDCSNAVVGQLC

SEQ ID NO: 9527 - protein, 12 aa, Artificial Sequence
  Description of Artificial Sequence: Synthetic peptide
LDCSIAALGELC

SEQ ID NO: 9528 - protein, 12 aa, Artificial Sequence
  Description of Artificial Sequence: Synthetic peptide
LDCSEAILGQLC

SEQ ID NO: 9529 - protein, 12 aa, Artificial Sequence
  Description of Artificial Sequence: Synthetic peptide
LDCGEAILGELC

SEQ ID NO: 9530 - protein, 12 aa, Artificial Sequence
  Description of Artificial Sequence: Synthetic peptide
LDCRDAVLGELC

SEQ ID NO: 9531 - protein, 12 aa, Artificial Sequence
  Description of Artificial Sequence: Synthetic peptide
LDCSRASLGELC

SEQ ID NO: 9532 - protein, 12 aa, Artificial Sequence
  Description of Artificial Sequence: Synthetic peptide
LDCSNAGWGDLC

SEQ ID NO: 9533 - protein, 12 aa, Artificial Sequence
  Description of Artificial Sequence: Synthetic peptide
LDCSEAVLGELC

SEQ ID NO: 9534 - protein, 12 aa, Artificial Sequence
  Description of Artificial Sequence: Synthetic peptide
LDCHLAVLGELC

SEQ ID NO: 9535 - protein, 12 aa, Artificial Sequence
  Description of Artificial Sequence: Synthetic peptide
LDCSVAVLGELC

SEQ ID NO: 9536 - protein, 12 aa, Artificial Sequence
  Description of Artificial Sequence: Synthetic peptide
LDCSEAWLGHLC

SEQ ID NO: 9537 - protein, 12 aa, Artificial Sequence
  Description of Artificial Sequence: Synthetic peptide
LDCSNAGVGDLC

SEQ ID NO: 9538 - protein, 12 aa, Artificial Sequence
  Description of Artificial Sequence: Synthetic peptide
LDCSIAALGELC

SEQ ID NO: 9539 - protein, 12 aa, Artificial Sequence
  Description of Artificial Sequence: Synthetic peptide
LDCSEAILGQLC

SEQ ID NO: 9540 - protein, 12 aa, Artificial Sequence
  Description of Artificial Sequence: Synthetic peptide
LDCHLAVLGELC

SEQ ID NO: 9541 - protein, 12 aa, Artificial Sequence
  Description of Artificial Sequence: Synthetic peptide
LDCSVAVLGELC

SEQ ID NO: 9542 - protein, 12 aa, Artificial Sequence
  Description of Artificial Sequence: Synthetic peptide
LDCRDAVLGELC

SEQ ID NO: 9543 - protein, 12 aa, Artificial Sequence
  Description of Artificial Sequence: Synthetic peptide
LDCSEAVLGELC

SEQ ID NO: 9544 - protein, 12 aa, Artificial Sequence
  Description of Artificial Sequence: Synthetic peptide
LDCGEAILGELC

SEQ ID NO: 9545 - protein, 12 aa, Artificial Sequence
  Description of Artificial Sequence: Synthetic peptide
LDCSEAVLGHLC

SEQ ID NO: 9546 - protein, 12 aa, Artificial Sequence
  Description of Artificial Sequence: Synthetic peptide
MDCSERALGELC

SEQ ID NO: 9547 - protein, 12 aa, Artificial Sequence
  Description of Artificial Sequence: Synthetic peptide
MDCSQAGLGELC

SEQ ID NO: 9548 - protein, 12 aa, Artificial Sequence
  Description of Artificial Sequence: Synthetic peptide
MDCREAALGELC

SEQ ID NO: 9549 - protein, 12 aa, Artificial Sequence
  Description of Artificial Sequence: Synthetic peptide
MDCWEAALGELC

SEQ ID NO: 9550 - protein, 12 aa, Artificial Sequence
  Description of Artificial Sequence: Synthetic peptide
MDCSEALLGELC

SEQ ID NO: 9551 - protein, 12 aa, Artificial Sequence
  Description of Artificial Sequence: Synthetic peptide
MDCYDARLGDLC

SEQ ID NO: 9552 - protein, 12 aa, Artificial Sequence
  Description of Artificial Sequence: Synthetic peptide
MDSSQAALGELC

SEQ ID NO: 9553 - protein, 12 aa, Artificial Sequence
  Description of Artificial Sequence: Synthetic peptide
MDCSQAGLGELC

SEQ ID NO: 9554 - protein, 12 aa, Artificial Sequence
  Description of Artificial Sequence: Synthetic peptide
MDCSQAALGDLC

SEQ ID NO: 9555 - protein, 12 aa, Artificial Sequence
  Description of Artificial Sequence: Synthetic peptide
MDCSWAWLGDLC

SEQ ID NO: 9556 - protein, 12 aa, Artificial Sequence
  Description of Artificial Sequence: Synthetic peptide
MDCSDAVLGDLC

SEQ ID NO: 9557 - protein, 12 aa, Artificial Sequence
  Description of Artificial Sequence: Synthetic peptide
MDCHEAALGHLC

SEQ ID NO: 9558 - protein, 12 aa, Artificial Sequence
  Description of Artificial Sequence: Synthetic peptide
MDCSQAVLGELC

SEQ ID NO: 9559 - protein, 12 aa, Artificial Sequence
  Description of Artificial Sequence: Synthetic peptide
MDCSIRALGELC

SEQ ID NO: 9560 - protein, 12 aa, Artificial Sequence
  Description of Artificial Sequence: Synthetic peptide
MDCRWAALGELC

SEQ ID NO: 9561 - protein, 12 aa, Artificial Sequence
  Description of Artificial Sequence: Synthetic peptide
MDCSKAALGELC

SEQ ID NO: 9562 - protein, 12 aa, Artificial Sequence
  Description of Artificial Sequence: Synthetic peptide
MDCSEAVLGELC

SEQ ID NO: 9563 - protein, 12 aa, Artificial Sequence
  Description of Artificial Sequence: Synthetic peptide
MDCSIRALGELC

SEQ ID NO: 9564 - protein, 12 aa, Artificial Sequence
  Description of Artificial Sequence: Synthetic peptide
MDCSERALGELC

SEQ ID NO: 9565 - protein, 12 aa, Artificial Sequence
  Description of Artificial Sequence: Synthetic peptide
MDCSERALGELC

SEQ ID NO: 9566 - protein, 12 aa, Artificial Sequence
  Description of Artificial Sequence: Synthetic peptide
MDCSQAALGDLC

SEQ ID NO: 9567 - protein, 12 aa, Artificial Sequence
  Description of Artificial Sequence: Synthetic peptide
MDCSVAVLGDLC

SEQ ID NO: 9568 - protein, 12 aa, Artificial Sequence
  Description of Artificial Sequence: Synthetic peptide
MDCREAALGELC

SEQ ID NO: 9569 - protein, 12 aa, Artificial Sequence
  Description of Artificial Sequence: Synthetic peptide
MDCWEAALGELC

SEQ ID NO: 9570 - protein, 12 aa, Artificial Sequence
  Description of Artificial Sequence: Synthetic peptide
MDCHEAALGHLC

SEQ ID NO: 9571 - protein, 12 aa, Artificial Sequence
  Description of Artificial Sequence: Synthetic peptide
MDCSQAVLGELC

SEQ ID NO: 9572 - protein, 12 aa, Artificial Sequence
  Description of Artificial Sequence: Synthetic peptide
MDCYDARLGDLC

SEQ ID NO: 9573 - protein, 12 aa, Artificial Sequence
  Description of Artificial Sequence: Synthetic peptide
MDSSQAALGELC

SEQ ID NO: 9574 - protein, 12 aa, Artificial Sequence
  Description of Artificial Sequence: Synthetic peptide
MDCSEAVLGELC

SEQ ID NO: 9575 - protein, 12 aa, Artificial Sequence
  Description of Artificial Sequence: Synthetic peptide
MDCSQAALGDLC

SEQ ID NO: 9576 - protein, 12 aa, Artificial Sequence
  Description of Artificial Sequence: Synthetic peptide
MDCSQAGLGELC

SEQ ID NO: 9577 - protein, 12 aa, Artificial Sequence
  Description of Artificial Sequence: Synthetic peptide
MDCSQAGLCELC

SEQ ID NO: 9578 - protein, 12 aa, Artificial Sequence
  Description of Artificial Sequence: Synthetic peptide
MDCSDAVLGDLC

SEQ ID NO: 9579 - protein, 12 aa, Artificial Sequence
  Description of Artificial Sequence: Synthetic peptide
MDCSEALLGELC

SEQ ID NO: 9580 - protein, 10 aa, Artificial Sequence
  Description of Artificial Sequence: Synthetic peptide
RWGDVGDLIG

SEQ ID NO: 9581 - protein, 10 aa, Artificial Sequence
  Description of Artificial Sequence: Synthetic peptide
RWGDVGDLIW

SEQ ID NO: 9582 - protein, 10 aa, Artificial Sequence
  Description of Artificial Sequence: Synthetic peptide
RWGDVGDLIG

SEQ ID NO: 9583 - protein, 10 aa, Artificial Sequence
  Description of Artificial Sequence: Synthetic peptide
RWGDVGDLIV

SEQ ID NO: 9584 - protein, 10 aa, Artificial Sequence
  Description of Artificial Sequence: Synthetic peptide
RWGDVGDLVS

SEQ ID NO: 9585 - protein, 10 aa, Artificial Sequence
  Description of Artificial Sequence: Synthetic peptide
RWGDVGDLVM

SEQ ID NO: 9586 - protein, 10 aa, Artificial Sequence
  Description of Artificial Sequence: Synthetic peptide
RWGDVGDMVE

SEQ ID NO: 9587 - protein, 10 aa, Artificial Sequence
  Description of Artificial Sequence: Synthetic peptide
RYGEVGDLLP

SEQ ID NO: 9588 - protein, 10 aa, Artificial Sequence
  Description of Artificial Sequence: Synthetic peptide
RWGDWGDLLP

SEQ ID NO: 9589 - protein, 10 aa, Artificial Sequence
  Description of Artificial Sequence: Synthetic peptide
RWGDWGDLIP

SEQ ID NO: 9590 - protein, 10 aa, Artificial Sequence
  Description of Artificial Sequence: Synthetic peptide
RWGDWGDLVA

SEQ ID NO: 9591 - protein, 10 aa, Artificial Sequence
  Description of Artificial Sequence: Synthetic peptide
RWGDWGDLVE

SEQ ID NO: 9592 - protein, 10 aa, Artificial Sequence
  Description of Artificial Sequence: Synthetic peptide
RWGDWGDLVW

SEQ ID NO: 9593 - protein, 10 aa, Artificial Sequence
  Description of Artificial Sequence: Synthetic peptide
RWGDWGDLVG

SEQ ID NO: 9594 - protein, 10 aa, Artificial Sequence
  Description of Artificial Sequence: Synthetic peptide
RWGDVGDLVP

SEQ ID NO: 9595 - protein, 10 aa, Artificial Sequence
  Description of Artificial Sequence: Synthetic peptide
RWGDWGDMVV

SEQ ID NO: 9596 - protein, 12 aa, Artificial Sequence
  Description of Artificial Sequence: Synthetic peptide
RACRVMPCLPDL

SEQ ID NO: 9597 - protein, 10 aa, Artificial Sequence
  Description of Artificial Sequence: Synthetic peptide
SGCGRELGWC

SEQ ID NO: 9598 - protein, 12 aa, Artificial Sequence
  Description of Artificial Sequence: Synthetic peptide
TECSEAGLWELC

SEQ ID NO: 9599 - protein, 12 aa, Artificial Sequence
  Description of Artificial Sequence: Synthetic peptide
TECSEAGLWELC

SEQ ID NO: 9600 - protein, 12 aa, Artificial Sequence
  Description of Artificial Sequence: Synthetic peptide
TECSEAGLWELC

SEQ ID NO: 9601 - protein, 9 aa, Artificial Sequence
  Description of Artificial Sequence: Synthetic peptide
TQEVYYSLL

SEQ ID NO: 9602 - protein, 12 aa, Artificial Sequence
  Description of Artificial Sequence: Synthetic peptide
VDCSEAVLGQLC

SEQ ID NO: 9603 - protein, 12 aa, Artificial Sequence
  Description of Artificial Sequence: Synthetic peptide
VDCSEAVLGQLC

SEQ ID NO: 9604 - protein, 11 aa, Artificial Sequence
  Description of Artificial Sequence: Synthetic peptide
WSGPGILGEYM

SEQ ID NO: 9605 - protein, 10 aa, Artificial Sequence
  Description of Artificial Sequence: Synthetic peptide
WDGPGLGEFF

SEQ ID NO: 9606 - protein, 11 aa, Artificial Sequence
  Description of Artificial Sequence: Synthetic peptide
WSGPGILGEFM

SEQ ID NO: 9607 - protein, 11 aa, Artificial Sequence
  Description of Artificial Sequence: Synthetic peptide
WYGPGILGEYM

SEQ ID NO: 9608 - protein, 10 aa, Artificial Sequence
  Description of Artificial Sequence: Synthetic peptide
WEGPGLGEYM

SEQ ID NO: 9609 - protein, 10 aa, Artificial Sequence
  Description of Artificial Sequence: Synthetic peptide
WEGPGILGEY

SEQ ID NO: 9610 - protein, 4 aa, Artificial Sequence
  Description of Artificial Sequence: Synthetic peptide
QMGG

SEQ ID NO: 9611 - protein, 5 aa, Artificial Sequence
  Description of Artificial Sequence: Synthetic peptide
RQMGG

SEQ ID NO: 9612 - protein, 4 aa, Artificial Sequence
  Description of Artificial Sequence: Synthetic peptide
VHRI

SEQ ID NO: 9613 - protein, 12 aa, Artificial Sequence
  Description of Artificial Sequence: Synthetic peptide
CGMAIGDLCMWT

SEQ ID NO: 9614 - protein, 12 aa, Artificial Sequence
  Description of Artificial Sequence: Synthetic peptide
DLSDLSTFWLSQ

SEQ ID NO: 9615 - protein, 4 aa, Artificial Sequence
  Description of Artificial Sequence: Synthetic peptide
  MISC_FEATURE (1)..(4): This sequence may encompass 1-4 residues
GGGG

SEQ ID NO: 9616 - protein, 5 aa, Artificial Sequence
  Description of Artificial Sequence: Synthetic peptide
  MISC_FEATURE (1)..(5): This sequence may encompass 1-5 residues
GGGGG

SEQ ID NO: 9617 - protein, 6 aa, Artificial Sequence
  Description of Artificial Sequence: Synthetic 6xHis tag
HHHHHH

SEQ ID NO: 9618 - protein, 12 aa, Artificial Sequence
  Description of Artificial Sequence: Synthetic peptide
APAPAPAPAPAP

SEQ ID NO: 9619 - protein, 10 aa, Artificial Sequence
  Description of Artificial Sequence: Synthetic peptide
  MISC_FEATURE (1)..(10): This sequence may encompass 1-10 residues
GGGGGGGGGG

SEQ ID NO: 9620 - protein, 8 aa, Artificial Sequence
  Description of Artificial Sequence: Synthetic peptide
  MISC_FEATURE (1)..(8): This sequence may encompass 1-8 residues
GGGGGGGG

SEQ ID NO: 9621 - protein, 6 aa, Artificial Sequence
  Description of Artificial Sequence: Synthetic peptide
  MISC_FEATURE (1)..(6): This sequence may encompass 1-6 residues
GGGGGG

SEQ ID NO: 9622 - protein, 23 aa, Artificial Sequence
  Description of Artificial Sequence: Synthetic peptide
GVQYKKCWMAQLGDLCELDPSGG

SEQ ID NO: 9623 - protein, 18 aa, Artificial Sequence
  Description of Artificial Sequence: Synthetic peptide
GGYPCWMAQLGELCDLGG

SEQ ID NO: 9624 - protein, 14 aa, Artificial Sequence
  Description of Artificial Sequence: Synthetic peptide
DCSMWEGVELCWGG

What is claimed is:

1. A dual receptor binding compound, wherein the dual receptor binding compound comprises:
    an IL-2Rβ ligand, wherein the IL-2Rβ ligand comprises an amino acid sequence of any one of SEQ ID NOS: 1-572, 574-655, 661-891, 900-926, 930-937, or 9301-9315;
    an Rγc ligand, wherein the Rγc ligand comprises an amino acid sequence of any one of SEQ ID NOS: 1001-1215, 1601-1613, or 9340-9353; and
    an IL-7Rα ligand, wherein the IL-7Rα ligand comprises an amino acid sequence of any one of SEQ ID NOS: 2001-2410, 2601, 2602, or 9320-9332.

2. The dual receptor binding compound of claim 1, wherein,
    the IL-2Rβ ligand comprises an amino acid sequence of any one of SEQ ID NOS: 395 and 9301-9315;
    the Rγc ligand comprises an amino acid sequence of any one of SEQ ID NOS: 1204 and 9340-9353; and
    the IL-7Rα ligand comprises an amino acid sequence of any one of SEQ ID NOS: 2047 and 9320-9332.

3. The dual receptor binding compound of claim 1, wherein,
    the IL-2Rβ ligand comprises an amino acid sequence of SEQ ID NO: 395;
    the Rγc ligand comprises an amino acid sequence of SEQ ID NO: 1204; and
    the IL-7Rα ligand comprises an amino acid sequence of SEQ ID NO: 2407.

4. The dual receptor binding compound of claim 1, wherein the dual receptor binding ligand has the structure of Formula (104a)-(104f).

5. The dual receptor binding compound of claim 1, wherein the dual receptor binding compound comprises an amino acid sequence of any one of SEQ ID NOS: 4041-4058.

6. The dual receptor binding compound of claim 1, wherein the dual receptor binding ligand has the structure of Formula (105a)-(105d), Formula (106a)-(106b), or Formula (107).

7. The dual receptor binding compound of claim 1, wherein the dual receptor binding compound comprises:
    an IL-2Rβγc ligand, wherein the IL-2Rβγc ligand comprises the IL-2Rβ ligand and the Rγc ligand; and
    an IL-7Rαγc ligand, wherein the IL-7Rαγc ligand comprises the IL-7Rα ligand and the Rγc ligand.

8. The dual receptor binding compound of claim 7, wherein,
    the IL-2Rβγc ligand comprises an amino acid sequence of any one of SEQ ID NOS: 4001-4007, 4070-4085, 4090-4094, or 4095-4099; and
    the IL-7Rαγc ligand comprises an amino acid sequence of any one of SEQ ID NOS: 4021-4028.

9. The dual receptor binding compound of claim 7, wherein,
    the IL-2Rβγc ligand is a full IL-2R agonist or a partial IL-2R agonist; and
    the IL-7Rαγc ligand is a full IL-7R agonist or a partial IL-7R agonist.

10. The dual receptor binding compound of claim 1, wherein the dual receptor binding compound comprises a construct partner.

11. The dual receptor binding compound of claim 10, wherein the construct partner is selected from a polymer, a polypeptide, an Fc-fragment, an immunoglobulin fragment, antibody, a viral surface antigen or a virus-like particle, a cytokine and a recombinant fusion protein.

12. The dual receptor binding compound of claim 10, wherein the construct partner is selected from a polyethylene glycol, a hIgG-Fc recombinant fusion protein, and a hIgG-Fc recombinant fusion protein.

13. The dual receptor binding compound of claim 10, wherein the construct partner comprises an antibody and the antibody is directed to a tumor antigen.

14. The dual receptor binding compound of claim 10, wherein the construct partner comprises a cell-targeting moiety, wherein cell-targeting moiety comprises a tumor-targeting moiety, an immune cell-targeting moiety, or a combination thereof.

15. The dual receptor binding compound of claim 10, wherein the dual receptor binding compound comprises a construct linker.

16. The dual receptor binding compound of claim 15, wherein the construct linker comprises a peptidyl ligand linker.

17. The dual receptor binding compound of claim 1, wherein the dual receptor binding compound comprises an amino acid sequence of any one of SEQ ID NOS: 8001-8007, 8012-8052, 8061-8082, 8101, and 8102, and PEG-1 to PEG-7.

18. The dual receptor binding compound of claim 1, wherein,
    the dual receptor binding compound binds to hIL-2R with an IC50 less than 100 μM and binds to hIL-7R with an IC50 less than 100 μM; and
    the dual receptor binding compound exhibits an $EC_{50}$ for STAT5 phosphorylation in TF-1β cells and/or NK-92 cells of less than 100 μM.

19. A pharmaceutical composition comprising a dual receptor binding compound of claim 1.

20. A method of treating a disease in a patient comprising administering to a patient in need of such treatment a therapeutically effective amount of the dual receptor binding compound of claim 1, wherein the disease is selected from cancer, an autoimmune disease, an inflammatory disease, an infectious disease, and a viral disease.

* * * * *